(12) United States Patent
Wang et al.

(10) Patent No.: US 7,258,860 B2
(45) Date of Patent: Aug. 21, 2007

(54) COMPOSITIONS AND METHODS FOR THE THERAPY AND DIAGNOSIS OF LUNG CANCER

(75) Inventors: Tongtong Wang, Medina, WA (US); David W Peckham, Seattle, WA (US); Marc W Retter, Carnation, WA (US); Gary R Fanger, Mill Creek, WA (US)

(73) Assignee: Corixa Corporation, Hamilton, MT (US)

( * ) Notice: Subject to any disclaimer, the term of this patent is extended or adjusted under 35 U.S.C. 154(b) by 490 days.

(21) Appl. No.: 10/623,155

(22) Filed: Jul. 17, 2003

(65) Prior Publication Data

US 2005/0261166 A1  Nov. 24, 2005

Related U.S. Application Data

(63) Continuation-in-part of application No. 10/313,986, filed on Dec. 4, 2002, now abandoned, which is a continuation-in-part of application No. 10/117,982, filed on Apr. 5, 2002, now abandoned, which is a continuation-in-part of application No. 10/007,700, filed on Nov. 30, 2001, now Pat. No. 6,960,570, which is a continuation-in-part of application No. 09/897,778, filed on Jun. 28, 2001, now abandoned, which is a continuation-in-part of application No. 09/850,716, filed on May 7, 2001, now abandoned, which is a continuation-in-part of application No. 09/735,705, filed on Dec. 12, 2000, now Pat. No. 7,049,063, which is a continuation-in-part of application No. 09/685,696, filed on Oct. 9, 2000, now abandoned, which is a continuation-in-part of application No. 09/662,786, filed on Sep. 15, 2000, now abandoned, which is a continuation-in-part of application No. 09/643,597, filed on Aug. 21, 2000, now Pat. No. 6,426,072, which is a continuation-in-part of application No. 09/630,940, filed on Aug. 2, 2000, now Pat. No. 6,737,514, which is a continuation-in-part of application No. 09/606,421, filed on Jun. 28, 2000, now Pat. No. 6,531,315, which is a continuation-in-part of application No. 09/542,615, filed on Apr. 4, 2000, now Pat. No. 6,518,256, which is a continuation-in-part of application No. 09/510,376, filed on Feb. 22, 2000, now abandoned, which is a continuation-in-part of application No. 09/480,884, filed on Jan. 10, 2000, now Pat. No. 6,482,597, which is a continuation-in-part of application No. 09/476,496, filed on Dec. 30, 1999, now Pat. No. 6,706,262, which is a continuation-in-part of application No. 09/466,396, filed on Dec. 17, 1999, now Pat. No. 6,696,247, which is a continuation-in-part of application No. 09/285,479, filed on Apr. 2, 1999, now Pat. No. 6,821,518, which is a continuation-in-part of application No. 09/221,107, filed on Dec. 22, 1998, now Pat. No. 6,660,838, which is a continuation-in-part of application No. 09/123,912, filed on Jul. 27, 1998, now Pat. No. 6,312,695, which is a continuation-in-part of application No. 09/040,802, filed on Mar. 18, 1998, now abandoned.

(51) Int. Cl.
A61K 39/38 (2006.01)
A01N 63/00 (2006.01)
C12N 15/00 (2006.01)
C12N 15/63 (2006.01)
C07H 21/04 (2006.01)

(52) U.S. Cl. ............... 424/184.1; 424/93.2; 435/320.1; 435/455; 536/23.5

(58) Field of Classification Search ............... 424/93.2, 424/184.1; 435/320.1, 455; 536/23.5, 23.1; 514/44

See application file for complete search history.

(56) References Cited

U.S. PATENT DOCUMENTS

| | | | | |
|---|---|---|---|---|
| 5,589,579 | A | 12/1996 | Torczynski et al. | 536/23.1 |
| 5,705,159 | A | 1/1998 | Irie et al. | 424/185.1 |
| 5,783,422 | A | 7/1998 | Suminami et al. | 435/69.3 |
| 6,200,764 | B1 | 3/2001 | Carney | 435/7.23 |
| 6,297,364 | B1 | 10/2001 | Chen et al. | 536/23.1 |
| 6,309,857 | B1 * | 10/2001 | Pauli et al. | 435/69.1 |
| 2002/0119463 | A1 | 8/2002 | Faris et al. | 435/6 |

FOREIGN PATENT DOCUMENTS

| | | |
|---|---|---|
| EP | 679716 A1 | 11/1994 |
| EP | 695760 A1 | 2/1996 |
| EP | 1033401 A2 | 9/2000 |
| EP | 1130094 A2 | 9/2001 |
| WO | WO91/18926 | 12/1991 |

(Continued)

OTHER PUBLICATIONS

Hillier et al., 1997, EST Accession No. AA429919, computer printout p. 17-18.*
Hillier et al., 1998, EST Accession No. AA160879, computer printout p. 31.*
Rudinger, 1976, Peptide Hormones, Parsons, University Park Press, Baltimore, p. 1-7.*

(Continued)

Primary Examiner—Shin-Lin Chen
(74) Attorney, Agent, or Firm—Seed IP Law Group PLLC

(57) ABSTRACT

Compositions and methods for the therapy and diagnosis of cancer, particularly lung cancer, are disclosed. Illustrative compositions comprise one or more lung tumor polypeptides, immunogenic portions thereof, polynucleotides that encode such polypeptides, antigen presenting cell that expresses such polypeptides, and T cells that are specific for cells expressing such polypeptides. The disclosed compositions are useful, for example, in the diagnosis, prevention and/or treatment of diseases, particularly lung cancer.

6 Claims, No Drawings

FOREIGN PATENT DOCUMENTS

| | | |
|---|---|---|
| WO | WO94/06929 | 9/1994 |
| WO | WO95/21862 | 8/1995 |
| WO | WO96/02552 | 2/1996 |
| WO | WO 96/02552 | 2/1996 |
| WO | WO96/13610 | 5/1996 |
| WO | WO96/28473 | 9/1996 |
| WO | WO96/30389 | 10/1996 |
| WO | WO97/07244 | 2/1997 |
| WO | WO98/35985 | 8/1998 |
| WO | WO98/46788 | 10/1998 |
| WO | WO99/06550 | 2/1999 |
| WO | WO99/38973 | 8/1999 |
| WO | WO99/44620 | 9/1999 |
| WO | WO99/46594 | 9/1999 |
| WO | WO99/47674 | 9/1999 |
| WO | WO99/54738 | 10/1999 |
| WO | WO 00/12711 | 9/2000 |
| WO | WO 00/61612 | 10/2000 |
| WO | WO 01/47944 | 7/2001 |
| WO | WO 01/55322 | 8/2001 |
| WO | WO 01/57272 | 8/2001 |
| WO | WO 01/57275 | 8/2001 |
| WO | WO 01/57276 | 8/2001 |
| WO | WO 01/57277 | 8/2001 |
| WO | WO 01/75067 | 10/2001 |
| WO | WO 01/94629 | 12/2001 |
| WO | WO 02/000174 | 1/2002 |
| WO | WO 02/10449 | 2/2002 |
| WO | WO 02/14366 | 2/2002 |
| WO | WO 02/20036 | 3/2002 |

OTHER PUBLICATIONS

Kaye et al., 1990, Proc. Natl. Acad. Sci. USA, vol. 87, pp. 6922-6926.*
Skolnick et al., 2000, Trends in Biotech, vol. 18, p. 34-39.*
Deonarain, 1998, Expert Opin. Ther. Pat., vol. 8, pp. 53-69.*
Verma, Sep. 1997, Nature, vol. 389, pp. 239-242.*
Crystal, 1995, Science, vol. 270, p. 404-410.*
Eck et al., 1996, Goodman & Gilman's The Pharmacological Basis of Therapeutics, McGraw-Hill, New York, p. 77-101.*
Ackermann, R. "Monoclonal antibodies," *Human Cell* 1(1): 46-53, 1988 (Abstract Only; PubMed ID:3154013).
Arceci, R.J, "The potential for antitumor vaccination in acute myelogenous leukemia," *J. Mol. Med.* 76: 80-93, 1998.
Baldi et al., "Differential expression of Rb2/p130 and p107 in normal human tissues and in primary lung cancer," *Clinical Cancer Research* 3(10):1691-1697, Oct. 1997.
Bergers and Coussens, "Extrinsic regulators of epithelial tumor progression: metalloproteinases," *Current Opinion in Genetics & Developments* 10: 120-127, 200.
Bodey, B. et al., "Failure of Cancer Vaccines: The Significant Limitations of this Approach to Immunotherapy," *Anticancer Research* 20: 2665-2676, 2000.
Boon, T., "Toward a Genetic Analysis of Tumor Rejection Antigens," *Advances in Cancer Research* 58: 177-210, 1992.
Brass et al., "Translation initiation factor eIF-4gamma is encoded by an amplified gene and induces an immune response in squamous cell lung carcinoma," *Human Molecular Genetics*, 6(1): 33-39, 1997.
Chen, Shen-Lin et al., "Isolation and characterization of a novel gene expressed in multiple cancers," *Oncogene* 12: 741-751, 1996.
Chen, Y.-T. et al., "A testicular antigen aberrantly expressed in human cancers detected by autologous antibody screening" *Proc. Natl. Acad. Sci. USA* 94: 1914-1918, Mar. 1997.
Database EMBL Nucleotide and Protein Sequence, Accession No. AI468638, Mar. 17, 1999.
Database EMBLest17 Accession No. AA340797:EST46165 Fetal kidney II Homo sapiens cDNA 3' end, Apr. 18, 1997.
Database EMBLest17 Accession No. W22264:Human retina cDNATsp-509I-cleaved sublibrary Homo sapiens cDNA not directional, May 9, 1996.
Davidson et al., "Lung tumours immunoreactive for parathyroid hormone related peptide: analysis of serum calcium levels and tumor type," *Journal of Pathology* 178:398-401, Jan. 1996.
Ezzell, C., "Cancer 'Vaccines': An Idea Whose Time Has Come?" *The Journal of NIH Research* 7: 46-49, Jan. 1995.
Finch et al., "Identification of a cloned sequence activated during multi-stage carcinogenesis in mouse skin," *Carcinogenesis*, 12(8):1519-1522, Aug. 1991.
GenBank Database, Accession No. AAB82295, Oct. 30, 1997.
GenBank Database, Accession No. AAB97457, Jan. 22, 1998.
GenBank Database, Accession No. AAC18597, Jun. 3, 1998.
GenBank Database, Accession No. AAC18598, Jun. 3, 1998.
GenBank Database, Accession No. AAC35208, May 13, 1007.
GenBank Database, Accession No. AAC41285, May 13, 1998.
GenBank Database, Accession No. AAD09223, Jan. 26, 1999.
GenBank Database, Accession No. AAD09827, Jan. 26, 1999.
GenBank Database, Accession No. AAD09828, Jan. 26, 1999.
GenBank Database, Accession No. AAD48397, Aug. 11, 1999.
GenBank Database, Accession No. AAF37203, Mar. 2, 2000.
GenBAnk Database, Accession No. AB026833, May 26, 1999.
GenBAnk Database, Accession No. AC005082, Sep. 8, 1999.
GenBank Database, Accession No. AC021876, Jan. 21, 2000.
GenBank Database, Accession No. AC079780, Feb. 21, 2002.
GenBank Database, Accession No. AC092447, Jul. 4, 2001.
GenBank Database, Accession No. AF043977, Jun. 23, 1999.
GenBank Database, Accession No. AF114429, Jan. 1, 2000.
GenBank Database, Accession No. AF117108, Jan. 26, 1999.
GenBank Database, Accession No. AF127980, Aug. 11, 1999.
GenBank Database, Accession No. AF198254, Mar. 2, 2000.
GenBank Database, Accession No. AL023775, Nov. 23, 1999.
GenBank Database, Accession No. BAA77810, May 26, 1999.
GenBank Database, Accession No. BAB19755, Dec. 20, 2000.
GenBank Database, Accession No. BAB27779, Feb. 8, 2001.
GenBank Database, Accession No. BAB27848, Feb. 8, 2001.
GenBAnk Database, Accession No. BC019258, Dec. 19, 2001.
GenBank Database, Accession No. NM_006536, Aug. 10, 1999.
GenBank Database, Accession No. NM_006547, Nov. 1, 2000.
GenBank Database, Accession No. NM_006527, Aug. 10, 1999.
GenBAnk Database, Accession No. NP_006537, Aug. 10, 1999.
GenBank Database, Accession No. NP_006538, Nov. 1, 2000.
GenBank Database, Accession No. NP_006539, Aug. 10, 1999.
GenBank Database, Accession No. NP_034081, Jan. 25, 2000.
GenBank Database, Accession No. NP_076159, Feb. 19, 2001.
GenBank Database, Accession No. NP_571566, Feb. 20, 2002.
GenBank Database, Accession No. O00425, Jul. 1, 1997.
GenBank Database, Accession No. U76705, Jan. 26, 1999.
GenBank Database, Accession No. U85946, Jul. 30, 1999.
GenBank Database, Accession No. U97188, May 20, 1997.
GenBAnk Database, Accession No. XM_004780, Nov. 16, 2000.
GenBank Database, Accession No. XP_004780, Nov. 16, 2000.
Geneseq Accession No. AAC66035, Feb. 21, 2001.
Geneseq Accession No. AAZ24653, Dec. 7, 1999.
Geneseq Accession No. AAZ36150, Dec. 7, 1999.
Geneseq Database (Thomson Derwent), Accession AAL28189, Jan. 24, 2002.
Geneseq Database (Thomson Derwent), Accession AAM93826, Nov. 6, 2001.
Geneseq Database (Thomson Derwent), Accession AAT26750, Oct. 23, 1996.
Geneseq Database (Thomson Derwent), Accession AAU16161, Nov. 7, 2001.
Geneseq Database (Thomson Derwent), Accession AAU16163, Nov. 7, 2001.
Geneseq Database (Thomson Derwent), Accession AAU16164, Nov. 7, 2001.
Geneseq Database (Thomson Derwent), Accession AAU16166, Nov. 7, 2001.
Geneseq Database (Thomson Derwent), Accession AAU16579, Nov. 7, 2001.

Genseq Database (Thomson Derwent), Accession AAU16583, Nov. 7, 2001.
Genseq Database (Derwent), Accession No. AAB45904, Mar. 21, 2001.
Genseq Database (Derwent), Accession No. AAC82881, Mar. 21, 2001.
Genseq Database (Derwent), Accession No. AAC82886, Mar. 21, 2001.
Genseq Database (Derwent), Accession No. AAC82887, Mar. 21, 2001.
Genseq Database (Derwent), Accession No. AAC82890, Mar. 21, 2001.
Genseq Database (Derwent), Accession No. AAC82893, Mar. 21, 2001.
Genseq Database (Derwent), Accession No. AAC82895, Mar. 21, 2001.
Genseq Database (Derwent), Accession No. AAC82896, Mar. 21, 2001.
Genseq Database (Derwent), Accession No. AAC82897, Mar. 21, 2001.
Genseq Database (Derwent), Accession No. AAC82898, Mar. 21, 2001.
Genseq Database (Derwent), Accession No. AAX40511, Jun. 18, 1999.
Genseq Database (Derwent), Accession No. AAY11789, Jun. 18, 1999.
Gerhold and Caskey, "It's the genes! EST access to human genome content," *BioEssays* 18(12):973-981, 19996.
Greenspan and Cooper, "Complementarity, specificity and the nature of epitopes and paratopes in multivalent interactions," *Immunology Today* 16(5): 226-230, 1995.
Gruber et al., "Molecular cloning and transmembrane structure of hCLCA2 from human lung, trachea, and mammary gland," *Am. J. Physiol.* 276(Cell Physiol 45):C1261-C1270, 1999.
Guo et al., "Identification and Characterization of homologues of the Exocyst component Sec10p," *FEBS Letters* 404(2-3):135-139, 1997.
Gura, T., "System for Identifying New Drugs Are Often Faulty," *Science* 278: 1041-1042, Nov. 7, 1997.
Güre, A.O. et al., "Human Lung Cancer Antigens Recognized by Autologous Antibodies: Definition of a Novel cDNA Derived from the Tumor Suppressor," *Cancer Research* 58: 1034-1041, Mar. 1, 1998.
Hara et al., "Characterization of cell phenotype by a novel cDNA library subtraction system: expression of CD8α in a mast cell-derived interleukin-4-dependent cell line," *Blood* 84(1):189-199, Jul. 1, 1994.
Henderson et al., "Identification of lung tumor antigens for cancer immunotherapy: immunological and molecular approaches," *Immunological Investigation* 29(2):87-91, May 2000.
Hogan et al., "The peptide recognized by HLA-A68.2-restricted, squamous cell carcinoma of the lung-specific cytotoxic T lymphocytes is derived from a mutated elongation factor 2 gene," *Cancer Research* 58(22):5144-5150, Nov. 15, 1998.
Hu et al., "A small proline-rich protein, sprl: specific marker for squamous lung carcinoma," *Lung Cancer* 20:25-30, 1998.
Jolly, D., "Viral vector systems for gene therapy," *Cancer Gene Therapy* 1(1):51-64, 1994.
Lee, K-H. et al., "Increased Vaccine-Specific T Cell Frequency After Peptide-Based Vaccination Correlates with Increased Susceptibility to In Vitro Stimulation But Does Not Lead to Tumor Regression," *The Journal of Immunology* 163: 6292-6300, 1999.
Lelievre et al., "Structural properties of chimeric peptides containing a T-cell epitope linked to a fusion peptide and their importance for in vivo induction of cytotoxic T-cell responses," *European Journal of Biochemistry* 249(3):895-904, 1997.
Marshall and Hodgson, "DNA chips: an array of possibilities," *Nature Biotechnology* 16:27-31, Jan. 1998.
Marusawa, H. et al., "HBXIP functions as a cofactor of surviving in apoptosis supression," *EMBO Journal* 22(11): 2729-2740, 2003.
Müeller-Pillasch, F. et al., "Cloning of a gene highly overexpressed in cancer coding for a novel KH-domain containing protein," *Oncogene* 14:2729-2733, 1997.
New England Biolabs website, Description on the pCyB Expression Vectors: http://circuit.neb.com/neb/faqs/impact2.html, (2001).

Nielsen, J. et al., "A Family of Insulin-Like Growth Factor II mRNA-Binding Proteins Represses Translation in Late Development," *Molecular and Cellular Biology* 19(2): 1262-1270, Feb. 1999.
Pastor et al., "Diagnostic value of SCC, CEA and CYFRA 21.1 in lung cancer: a Bayesian analysis," *Eur. Respir. J.* 10(3):603-609, Mar. 1997.
Radoja and Frey, "Cancer-induced Defective Cytotoxic T Lymphocyte Effector Function: Another Mechanism How Antigenic Tumors Escape Immune-mediated Killing," *Molecular Medicine* 6(6): 465-479, Jun. 2000.
Rammensee et al., "MHC ligands and peptide motifs: first listing," *Immunogentics* 41:178-228, 1995.
Ramsay, G., "DNA chips: state-of-the-art," *Nature Biotechnology* 16:40-44, Jan. 1998.
Ruppert et al., "Prominent role of secondary anchor residues in peptide binding to HLA-A2.1 molecules," *Cell* 74:929-937, Sep. 10, 1993.
Russell and Barton, "Structural features can be unconserved in proteins with similar fold," *J. Mol. Biol.* 244:332-350, 1994.
Sherman et al., "Selection T cell receptors with high affinity for self-MHC by decreasing the contribution of CD8," *Science* 258:815-818, Oct. 30, 1992.
Sjölander, A. et al., "Kinetics, localization and cytokine profile of T cell responses to immune stimulating complexes (iscoms) containing human influenza virus envelope glycoproteins," *Vaccine* 15(9): 1030-1038, 1997.
Skeiky et al., "Cloning, expression and immunological evaluation of two putative secreted serine protease antigens of Mycobacterium tuberculosis," *Infection and Immunity* 67(8):3998-4007,, Aug. 1999.
Spitler, L.E., "Cancer Vaccines: The Interferon Analogy," *Cancer Biotherapy* 10(1): 1-3, 1995.
Stern, P.S., "Predicting antigenic sites on proteins," *Trends in Biotechnology* 9: 163-169, May 1991.
Theobald et al., "Targeting p53 as a general tumour antigen," *Proc. Natl. Acad. Sci. USA* 92:11993-11997, Dec. 1995.
Timmerman and Levy, "Dendritic Cell Vaccines for Cancer Immunotherapy," *Annu. Rev. Med.* 50: 507-529, 1999.
Visseren et al., "Identification of HLA-A *0201-restricted CTL epitopes encoded by the tumor-specific MAGE-2 gene product," *International Journal of Cancer* 73(1):125-130, 1997.
Wang et al., "Identification of genes differentially over-expressed in lung squamous cell carcinoma using combination of cDNA subtraction and microarray analysis," *Oncogene* 19(12):1519-1528, Mar. 16, 2000.
Wells and Peitsch, "The chemokine information source: identification and characterization of novel chemokines using the WorldWideWeb and expressed sequence tag databases," *Journal of Leukocyte Biology* 61:545-550, May 1997.
Wong, C.P. et al., "TCR Vaccines Against T Cell Lymphoma: QS-21 and IL-12 Adjuvants Induced a Protective CD8+ T Cell Response," *Journal of Immunology* 162: 2251-2258, 1999.
Yee et al., "Isolation of tryosinase-specific CD8+ and CD4+ T cell clones from the peripheral blood of melanoma patients following in vitro stimulation with recombinant vaccinia virus," *The Journal of Immunology* 157:4079-4086, 1996.
Zaks and Rosenberg, "Immunization with Peptide Epitope (pp. 369-377) from HER-2/neu Leads to Peptide-specific Cytotoxic T Lymphocytes That Fail to Recognize HER-2/neu+ Tumors," *Cancer Research* 58: 4902-4908, Nov. 1, 1998.
Cunningham, S.A. et al., "Cloning of an Epithelial Chloride Channel from Bovine Trachea," *The Journal of Biological Chemistry* 270(52): 31016-31026, Dec. 29, 1995.
Elble, R.C. et al., "Cloning and Characterization of Lung-Endothelial Cell Adhesion Molecule-1 Suggest It Is an Endothelial Chloride Channel," *The Journal of Biological Chemistry* 272(44): 27853-27861, Oct. 31, 1997.
Konopitzky, R. et al., "Identification of HLA-A 0201-Restricted T Cell Epitopes Derived from the Novel Overexpressed Tumor Antigen Calcium-Activated Chloride Channel 2," *The Journal of Immunology* 169: 540-547, 2002.
Li, X. et al., "CLCA2 tumour suppressor gene in 1p31 is epigenetically regulated in breast cancer," *Oncogene* 23: 1474-1480, 2004.

* cited by examiner

COMPOSITIONS AND METHODS FOR THE THERAPY AND DIAGNOSIS OF LUNG CANCER

TECHNICAL FIELD OF THE INVENTION

The present invention relates generally to therapy and diagnosis of cancer, such as lung cancer. The invention is more specifically related to polypeptides, comprising at least a portion of a lung tumor protein, and to polynucleotides encoding such polypeptides. Such polypeptides and polynucleotides are useful in pharmaceutical compositions, e.g., vaccines, and other compositions for the diagnosis and treatment of lung cancer.

BACKGROUND OF THE INVENTION

1. Field of the Invention

Cancer is a significant health problem throughout the world. Although advances have been made in detection and therapy of cancer, no vaccine or other universally successful method for prevention and/or treatment is currently available. Current therapies, which are generally based on a combination of chemotherapy or surgery and radiation, continue to prove inadequate in many patients.

2. Description of Related Art

Lung cancer is the primary cause of cancer death among both men and women in the U.S., with an estimated 172,000 new cases being reported in 1994. The five-year survival rate among all lung cancer patients, regardless of the stage of disease at diagnosis, is only 13%. This contrasts with a five-year survival rate of 46% among cases detected while the disease is still localized. However, only 16% of lung cancers are discovered before the disease has spread.

In spite of considerable research into therapies for these and other cancers, lung cancer remains difficult to diagnose and treat effectively. Accordingly, there is a need in the art for improved methods for detecting and treating such cancers. The present invention fulfills these needs and further provides other related advantages.

SUMMARY OF THE INVENTION

In one aspect, the present invention provides polynucleotide compositions comprising a sequence selected from the group consisting of:

(a) sequences provided in SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489;

(b) complements of the sequences provided in SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489;

(c) sequences consisting of at least 10, 15, 20, 25, 30, 35, 40, 45, 50, 75 and 100 contiguous residues of a sequence provided in SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489;

(d) sequences that hybridize to a sequence provided in SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489, under moderate or highly stringent conditions;

(e) sequences having at least 75%, 80%, 85%, 90%, 95%, 96%, 97%, 98% or 99% identity to a sequence of SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489; and (f) degenerate variants of a sequence provided in SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489.

In one preferred embodiment, the polynucleotide compositions of the invention are expressed in at least about 20%, more preferably in at least about 30%, and most preferably in at least about 50% of lung tumors samples tested, at a level that is at least about 2-fold, preferably at least about 5-fold, and most preferably at least about 10-fold higher than that for normal tissues.

The present invention, in another aspect, provides polypeptide compositions comprising an amino acid sequence that is encoded by a polynucleotide sequence described above.

The present invention further provides polypeptide compositions comprising an amino acid sequence selected from the group consisting of sequences recited in SEQ ID NO:152, 155, 156, 165, 166, 169, 170, 172, 174, 176, 226-252, 338-344, 346, 350, 357, 361, 363, 365, 367, 369, 376-382, 387-419, 423, 427, 430, 433, 441, 443, 446, 449, 451-466, 468-477, 480-482, 484, 486, and 490-560.

In certain preferred embodiments, the polypeptides and/or polynucleotides of the present invention are immunogenic, i.e., they are capable of eliciting an immune response, particularly a humoral and/or cellular immune response, as further described herein.

The present invention further provides fragments, variants and/or derivatives of the disclosed polypeptide and/or polynucleotide sequences, wherein the fragments, variants and/or derivatives preferably have a level of immunogenic activity of at least about 50%, preferably at least about 70% and more preferably at least about 90% of the level of immunogenic activity of a polypeptide sequence set forth in SEQ ID NO:152, 155, 156, 165, 166, 169, 170, 172, 174, 176, 226-252, 338-344, 346, 350, 357, 361, 363, 365, 367, 369, 376-382, 387-419, 423, 427, 430, 433, 441, 443, 446, 449, 451-466, 486, and 490-560, or a polypeptide sequence encoded by a polynucleotide sequence set forth in SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489.

The present invention further provides polynucleotides that encode a polypeptide described above, expression vectors comprising such polynucleotides and host cells transformed or transfected with such expression vectors.

Within other aspects, the present invention provides pharmaceutical compositions comprising a polypeptide or polynucleotide as described above and a physiologically acceptable carrier.

Within a related aspect of the present invention, the pharmaceutical compositions, e.g., vaccine compositions, are provided for prophylactic or therapeutic applications. Such compositions generally comprise an immunogenic polypeptide or polynucleotide of the invention and an immunostimulant, such as an adjuvant.

The present invention further provides pharmaceutical compositions that comprise: (a) an antibody or antigen-binding fragment thereof that specifically binds to a polypeptide of the present invention, or a fragment thereof; and (b) a physiologically acceptable carrier.

Within further aspects, the present invention provides pharmaceutical compositions comprising: (a) an antigen presenting cell that expresses a polypeptide as described above and (b) a pharmaceutically acceptable carrier or excipient. Illustrative antigen presenting cells include dendritic cells, macrophages, monocytes, fibroblasts and B cells.

Within related aspects, pharmaceutical compositions are provided that comprise: (a) an antigen presenting cell that expresses a polypeptide as described above and (b) an immunostimulant.

The present invention further provides, in other aspects, fusion proteins that comprise at least one polypeptide as described above, as well as polynucleotides encoding such fusion proteins, typically in the form of pharmaceutical compositions, e.g., vaccine compositions, comprising a physiologically acceptable carrier and/or an immunostimulant. The fusions proteins may comprise multiple immunogenic polypeptides or portions/variants thereof, as described herein, and may further comprise one or more polypeptide segments for facilitating the expression, purification and/or immunogenicity of the polypeptide(s).

Within further aspects, the present invention provides methods for stimulating an immune response in a patient, preferably a T cell response in a human patient, comprising administering a pharmaceutical composition described herein. The patient may be afflicted with lung cancer, in which case the methods provide treatment for the disease, or patient considered at risk for such a disease may be treated prophylactically.

Within further aspects, the present invention provides methods for inhibiting the development of a cancer in a patient, comprising administering to a patient a pharmaceutical composition as recited above. The patient may be afflicted with lung cancer, in which case the methods provide treatment for the disease, or patient considered at risk for such a disease may be treated prophylactically.

The present invention further provides, within other aspects, methods for removing tumor cells from a biological sample, comprising contacting a biological sample with T cells that specifically react with a polypeptide of the present invention, wherein the step of contacting is performed under conditions and for a time sufficient to permit the removal of cells expressing the protein from the sample.

Within related aspects, methods are provided for inhibiting the development of a cancer in a patient, comprising administering to a patient a biological sample treated as described above.

Methods are further provided, within other aspects, for stimulating and/or expanding T cells specific for a polypeptide of the present invention, comprising contacting T cells with one or more of: (i) a polypeptide as described above; (ii) a polynucleotide encoding such a polypeptide; and/or (iii) an antigen presenting cell that expresses such a polypeptide; under conditions and for a time sufficient to permit the stimulation and/or expansion of T cells. Isolated T cell populations comprising T cells prepared as described above are also provided.

Within further aspects, the present invention provides methods for inhibiting the development of a cancer in a patient, comprising administering to a patient an effective amount of a T cell population as described above.

The present invention further provides methods for inhibiting the development of a cancer in a patient, comprising the steps of: (a) incubating $CD4^+$ and/or $CD8^+$ T cells isolated from a patient with one or more of: (i) a polypeptide comprising at least an immunogenic portion of polypeptide disclosed herein; (ii) a polynucleotide encoding such a polypeptide; and (iii) an antigen-presenting cell that expressed such a polypeptide; and (b) administering to the patient an effective amount of the proliferated T cells, and thereby inhibiting the development of a cancer in the patient. Proliferated cells may, but need not, be cloned prior to administration to the patient.

Within further aspects, the present invention provides methods for determining the presence or absence of a cancer, preferably a lung cancer, in a patient comprising: (a) contacting a biological sample obtained from a patient with a binding agent that binds to a polypeptide as recited above; (b) detecting in the sample an amount of polypeptide that binds to the binding agent; and (c) comparing the amount of polypeptide with a predetermined cut-off value, and therefrom determining the presence or absence of a cancer in the patient. Within preferred embodiments, the binding agent is an antibody, more preferably a monoclonal antibody.

The present invention also provides, within other aspects, methods for monitoring the progression of a cancer in a patient. Such methods comprise the steps of: (a) contacting a biological sample obtained from a patient at a first point in time with a binding agent that binds to a polypeptide as recited above; (b) detecting in the sample an amount of polypeptide that binds to the binding agent; (c) repeating steps (a) and (b) using a biological sample obtained from the patient at a subsequent point in time; and (d) comparing the amount of polypeptide detected in step (c) with the amount detected in step (b) and therefrom monitoring the progression of the cancer in the patient.

The present invention further provides, within other aspects, methods for determining the presence or absence of a cancer in a patient, comprising the steps of: (a) contacting a biological sample obtained from a patient with an oligonucleotide that hybridizes to a polynucleotide that encodes a polypeptide of the present invention; (b) detecting in the sample a level of a polynucleotide, preferably mRNA, that hybridizes to the oligonucleotide; and (c) comparing the level of polynucleotide that hybridizes to the oligonucleotide with a predetermined cut-off value, and therefrom determining the presence or absence of a cancer in the patient. Within certain embodiments, the amount of mRNA is detected via polymerase chain reaction using, for example, at least one oligonucleotide primer that hybridizes to a polynucleotide encoding a polypeptide as recited above, or a complement of such a polynucleotide. Within other embodiments, the amount of mRNA is detected using a hybridization technique, employing an oligonucleotide probe that hybridizes to a polynucleotide that encodes a polypeptide as recited above, or a complement of such a polynucleotide.

In related aspects, methods are provided for monitoring the progression of a cancer in a patient, comprising the steps of: (a) contacting a biological sample obtained from a patient with an oligonucleotide that hybridizes to a polynucleotide that encodes a polypeptide of the present invention; (b) detecting in the sample an amount of a polynucleotide that hybridizes to the oligonucleotide; (c) repeating steps (a) and (b) using a biological sample obtained from the patient at a subsequent point in time; and (d) comparing the amount of polynucleotide detected in step (c) with the amount detected in step (b) and therefrom monitoring the progression of the cancer in the patient.

Within further aspects, the present invention provides antibodies, such as monoclonal antibodies, that bind to a polypeptide as described above, as well as diagnostic kits comprising such antibodies. Diagnostic kits comprising one or more oligonucleotide probes or primers as described above are also provided.

These and other aspects of the present invention will become apparent upon reference to the following detailed description. All references disclosed herein are hereby incorporated by reference in their entirety as if each was incorporated individually.

A BRIEF DESCRIPTION OF THE SEQUENCE IDENTIFIERS

SEQ ID NO:1 is the determined cDNA sequence for LST-S1-2

SEQ ID NO:2 is the determined cDNA sequence for LST-S1-28

SEQ ID NO:3 is the determined cDNA sequence for LST-S1-90

SEQ ID NO:4 is the determined cDNA sequence for LST-S1-144

SEQ ID NO:5 is the determined cDNA sequence for LST-S1-133

SEQ ID NO:6 is the determined cDNA sequence for LST-S1-169

SEQ ID NO:7 is the determined cDNA sequence for LST-S2-6

SEQ ID NO:8 is the determined cDNA sequence for LST-S2-11

SEQ ID NO:9 is the determined cDNA sequence for LST-S2-17

SEQ ID NO:10 is the determined cDNA sequence for LST-S2-25

SEQ ID NO:11 is the determined cDNA sequence for LST-S2-39

SEQ ID NO:12 is a first determined cDNA sequence for LST-S2-43

SEQ ID NO:13 is a second determined cDNA sequence for LST-S2-43

SEQ ID NO:14 is the determined cDNA sequence for LST-S2-65

SEQ ID NO:15 is the determined cDNA sequence for LST-S2-68

SEQ ID NO:16 is the determined cDNA sequence for LST-S2-72

SEQ ID NO:17 is the determined cDNA sequence for LST-S2-74

SEQ ID NO:18 is the determined cDNA sequence for LST-S2-103

SEQ ID NO:19 is the determined cDNA sequence for LST-S2-N-1-1F

SEQ ID NO:20 is the determined cDNA sequence for LST-S2-N-1-2A

SEQ ID NO:21 is the determined cDNA sequence for LST-S2-N-1-4H

SEQ ID NO:22 is the determined cDNA sequence for LST-S2-N-1-5A

SEQ ID NO:23 is the determined cDNA sequence for LST-S2-N-1-6B

SEQ ID NO:24 is the determined cDNA sequence for LST-S2-N-1-7B

SEQ ID NO:25 is the determined cDNA sequence for LST-S2-N-1-7H

SEQ ID NO:26 is the determined cDNA sequence for LST-S2-N-1-8A

SEQ ID NO:27 is the determined cDNA sequence for LST-S2-N-1-8D

SEQ ID NO:28 is the determined cDNA sequence for LST-S2-N-1-9A

SEQ ID NO:29 is the determined cDNA sequence for LST-S2-N-1-9E

SEQ ID NO:30 is the determined cDNA sequence for LST-S2-N-1-10A

SEQ ID NO:31 is the determined cDNA sequence for LST-S2-N1-10G

SEQ ID NO:32 is the determined cDNA sequence for LST-S2-N1-11A

SEQ ID NO:33 is the determined cDNA sequence for LST-S2-N1-12C

SEQ ID NO:34 is the determined cDNA sequence for LST-S2-N-1-12E

SEQ ID NO:35 is the determined cDNA sequence for LST-S2-B1-3D

SEQ ID NO:36 is the determined cDNA sequence for LST-S2-B1-6C

SEQ ID NO:37 is the determined cDNA sequence for LST-S2-B1-5D

SEQ ID NO:38 is the determined cDNA sequence for LST-S2-B1-5F

SEQ ID NO:39 is the determined cDNA sequence for LST-S2-B1-6G

SEQ ID NO:40 is the determined cDNA sequence for LST-S2-B1-8A

SEQ ID NO:41 is the determined cDNA sequence for LST-S2-B1-8D

SEQ ID NO:42 is the determined cDNA sequence for LST-S2-B1-10A

SEQ ID NO:43 is the determined cDNA sequence for LST-S2-B1-9B

SEQ ID NO:44 is the determined cDNA sequence for LST-S2-B1-9F

SEQ ID NO:45 is the determined cDNA sequence for LST-S2-B1-12D

SEQ ID NO:46 is the determined cDNA sequence for LST-S2-I2-2B

SEQ ID NO:47 is the determined cDNA sequence for LST-S2-I2-5F
SEQ ID NO:48 is the determined cDNA sequence for LST-S2-I2-6B
SEQ ID NO:49 is the determined cDNA sequence for LST-S2-I2-7F
SEQ ID NO:50 is the determined cDNA sequence for LST-S2-I2-8G
SEQ ID NO:51 is the determined cDNA sequence for LST-S2-I2-9E
SEQ ID NO:52 is the determined cDNA sequence for LST-S2-I2-12B
SEQ ID NO:53 is the determined cDNA sequence for LST-S2-H2-2C
SEQ ID NO:54 is the determined cDNA sequence for LST-S2-H2-1G
SEQ ID NO:55 is the determined cDNA sequence for LST-S2-H2-4G
SEQ ID NO:56 is the determined cDNA sequence for LST-S2-H2-3H
SEQ ID NO:57 is the determined cDNA sequence for LST-S2-H2-5G
SEQ ID NO:58 is the determined cDNA sequence for LST-S2-H2-9B
SEQ ID NO:59 is the determined cDNA sequence for LST-S2-H2-10H
SEQ ID NO:60 is the determined cDNA sequence for LST-S2-H2-12D
SEQ ID NO: 61 is the determined cDNA sequence for LST-S3-2
SEQ ID NO: 62 is the determined cDNA sequence for LST-S3-4
SEQ ID NO: 63 is the determined cDNA sequence for LST-S3-7
SEQ ID NO: 64 is the determined cDNA sequence for LST-S3-8
SEQ ID NO: 65 is the determined cDNA sequence for LST-S3-12
SEQ ID NO: 66 is the determined cDNA sequence for LST-S3-13
SEQ ID NO: 67 is the determined cDNA sequence for LST-S3-14
SEQ ID NO: 68 is the determined cDNA sequence for LST-S3-16
SEQ ID NO: 69 is the determined cDNA sequence for LST-S3-21
SEQ ID NO: 70 is the determined cDNA sequence for LST-S3-22
SEQ ID NO: 71 is the determined cDNA sequence for LST-S1-7
SEQ ID NO: 72 is the determined cDNA sequence for LST-S1-A-1E
SEQ ID NO: 73 is the determined cDNA sequence for LST-S1-A-1G
SEQ ID NO: 74 is the determined cDNA sequence for LST-S1-A-3E
SEQ ID NO: 75 is the determined cDNA sequence for LST-S1-A-4E
SEQ ID NO: 76 is the determined cDNA sequence for LST-S1-A-6D
SEQ ID NO: 77 is the determined cDNA sequence for LST-S1-A-8D
SEQ ID NO: 78 is the determined cDNA sequence for LST-S1-A-10A
SEQ ID NO: 79 is the determined cDNA sequence for LST-S1-A-10C
SEQ ID NO: 80 is the determined cDNA sequence for LST-S1-A-9D
SEQ ID NO: 81 is the determined cDNA sequence for LST-S1-A-10D
SEQ ID NO: 82 is the determined cDNA sequence for LST-S1-A-9H
SEQ ID NO: 83 is the determined cDNA sequence for LST-S1-A-11D
SEQ ID NO: 84 is the determined cDNA sequence for LST-S1-A-12D
SEQ ID NO: 85 is the determined cDNA sequence for LST-S1-A-11E
SEQ ID NO: 86 is the determined cDNA sequence for LST-S1-A-12E
SEQ ID NO: 87 is the determined cDNA sequence for L513S (T3).
SEQ ID NO: 88 is the determined cDNA sequence for L513S contig 1.
SEQ ID NO: 89 is a first determined cDNA sequence for L514S.
SEQ ID NO: 90 is a second determined cDNA sequence for L514S.
SEQ ID NO: 91 is a first determined cDNA sequence for L516S.
SEQ ID NO: 92 is a second determined cDNA sequence for L516S.
SEQ ID NO: 93 is the determined cDNA sequence for L517S.
SEQ ID NO: 94 is the extended cDNA sequence for LST-S1-169 (also known as L519S).
SEQ ID NO: 95 is a first determined cDNA sequence for L520S.
SEQ ID NO: 96 is a second determined cDNA sequence for L520S.
SEQ ID NO: 97 is a first determined cDNA sequence for L521S.
SEQ ID NO: 98 is a second determined cDNA sequence for L521S.
SEQ ID NO: 99 is the determined cDNA sequence for L522S.
SEQ ID NO: 100 is the determined cDNA sequence for L523S.
SEQ ID NO: 101 is the determined cDNA sequence for L524S.
SEQ ID NO: 102 is the determined cDNA sequence for L525S.
SEQ ID NO: 103 is the determined cDNA sequence for L526S.
SEQ ID NO: 104 is the determined cDNA sequence for L527S.
SEQ ID NO: 105 is the determined cDNA sequence for L528S.
SEQ ID NO: 106 is the determined cDNA sequence for L529S.
SEQ ID NO: 107 is a first determined cDNA sequence for L530S.
SEQ ID NO: 108 is a second determined cDNA sequence for L530S.
SEQ ID NO: 109 is the determined full-length cDNA sequence for L531S short form
SEQ ID NO: 110 is the amino acid sequence encoded by SEQ ID NO: 109.
SEQ ID NO: 111 is the determined full-length cDNA sequence for L531S long form
SEQ ID NO: 112 is the amino acid sequence encoded by SEQ ID NO: 111.

SEQ ID NO: 113 is the determined full-length cDNA sequence for L520S.
SEQ ID NO: 114 is the amino acid sequence encoded by SEQ ID NO: 113.
SEQ ID NO: 115 is the determined cDNA sequence for contig 1.
SEQ ID NO: 116 is the determined cDNA sequence for contig 3.
SEQ ID NO: 117 is the determined cDNA sequence for contig 4.
SEQ ID NO: 118 is the determined cDNA sequence for contig 5.
SEQ ID NO: 119 is the determined cDNA sequence for contig 7.
SEQ ID NO: 120 is the determined cDNA sequence for contig 8.
SEQ ID NO: 121 is the determined cDNA sequence for contig 9.
SEQ ID NO: 122 is the determined cDNA sequence for contig 10.
SEQ ID NO: 123 is the determined cDNA sequence for contig 12.
SEQ ID NO: 124 is the determined cDNA sequence for contig 11.
SEQ ID NO: 125 is the determined cDNA sequence for contig 13 (also known as L761P).
SEQ ID NO: 126 is the determined cDNA sequence for contig 15.
SEQ ID NO: 127 is the determined cDNA sequence for contig 16.
SEQ ID NO: 128 is the determined cDNA sequence for contig 17.
SEQ ID NO: 129 is the determined cDNA sequence for contig 19.
SEQ ID NO: 130 is the determined cDNA sequence for contig 20.
SEQ ID NO: 131 is the determined cDNA sequence for contig 22.
SEQ ID NO: 132 is the determined cDNA sequence for contig 24.
SEQ ID NO: 133 is the determined cDNA sequence for contig 29.
SEQ ID NO: 134 is the determined cDNA sequence for contig 31.
SEQ ID NO: 135 is the determined cDNA sequence for contig 33.
SEQ ID NO: 136 is the determined cDNA sequence for contig 38.
SEQ ID NO: 137 is the determined cDNA sequence for contig 39.
SEQ ID NO: 138 is the determined cDNA sequence for contig 41.
SEQ ID NO: 139 is the determined cDNA sequence for contig 43.
SEQ ID NO: 140 is the determined cDNA sequence for contig 44.
SEQ ID NO: 141 is the determined cDNA sequence for contig 45.
SEQ ID NO: 142 is the determined cDNA sequence for contig 47.
SEQ ID NO: 143 is the determined cDNA sequence for contig 48.
SEQ ID NO: 144 is the determined cDNA sequence for contig 49.
SEQ ID NO: 145 is the determined cDNA sequence for contig 50.
SEQ ID NO: 146 is the determined cDNA sequence for contig 53.
SEQ ID NO: 147 is the determined cDNA sequence for contig 54.
SEQ ID NO: 148 is the determined cDNA sequence for contig 56.
SEQ ID NO: 149 is the determined cDNA sequence for contig 57.
SEQ ID NO: 150 is the determined cDNA sequence for contig 58.
SEQ ID NO: 151 is the full-length cDNA sequence for L530S.
SEQ ID NO: 152 is the amino acid sequence encoded by SEQ ID NO: 151
SEQ ID NO: 153 is the full-length cDNA sequence of a first variant of L514S
SEQ ID NO: 154 is the full-length cDNA sequence of a second variant of L514S
SEQ ID NO: 155 is the amino acid sequence encoded by SEQ ID NO: 153.
SEQ ID NO: 156 is the amino acid sequence encoded by SEQ ID NO: 154.
SEQ ID NO: 157 is the determined cDNA sequence for contig 59.
SEQ ID NO: 158 is the full-length cDNA sequence for L763P (also referred to as contig 22).
SEQ ID NO: 159 is the amino acid sequence encoded by SEQ ID NO: 158.
SEQ ID NO: 160 is the full-length cDNA sequence for L762P (also referred to as contig 17).
SEQ ID NO: 161 is the amino acid sequence encoded by SEQ ID NO: 160.
SEQ ID NO: 162 is the determined cDNA sequence for L515S.
SEQ ID NO: 163 is the full-length cDNA sequence of a first variant of L524S.
SEQ ID NO: 164 is the full-length cDNA sequence of a second variant of L524S.
SEQ ID NO: 165 is the amino acid sequence encoded by SEQ ID NO: 163.
SEQ ID NO: 166 is the amino acid sequence encoded by SEQ ID NO: 164.
SEQ ID NO: 167 is the full-length cDNA sequence of a first variant of L762P.
SEQ ID NO: 168 is the full-length cDNA sequence of a second variant of L762P.
SEQ ID NO: 169 is the amino acid sequence encoded by SEQ ID NO: 167.
SEQ ID NO: 170 is the amino acid sequence encoded by SEQ ID NO: 168.
SEQ ID NO: 171 is the full-length cDNA sequence for L773P (also referred to as contig 56).
SEQ ID NO: 172 is the amino acid sequence encoded by SEQ ID NO: 171.
SEQ ID NO: 173 is an extended cDNA sequence for L519S.
SEQ ID NO: 174 is the amino acid sequence encoded by SEQ ID NO: 174.
SEQ ID NO: 175 is the full-length cDNA sequence for L523S.
SEQ ID NO: 176 is the amino acid sequence encoded by SEQ ID NO: 175.
SEQ ID NO: 177 is the determined cDNA sequence for LST-sub5-7A.
SEQ ID NO: 178 is the determined cDNA sequence for LST-sub5-8G.

SEQ ID NO: 179 is the determined cDNA sequence for LST-sub5-8H.
SEQ ID NO: 180 is the determined cDNA sequence for LST-sub5-10B.
SEQ ID NO: 181 is the determined cDNA sequence for LST-sub5-10H.
SEQ ID NO: 182 is the determined cDNA sequence for LST-sub5-12B.
SEQ ID NO: 183 is the determined cDNA sequence for LST-sub5-11C.
SEQ ID NO: 184 is the determined cDNA sequence for LST-sub6-1c.
SEQ ID NO: 185 is the determined cDNA sequence for LST-sub6-2f.
SEQ ID NO: 186 is the determined cDNA sequence for LST-sub6-2G.
SEQ ID NO: 187 is the determined cDNA sequence for LST-sub6-4d.
SEQ ID NO: 188 is the determined cDNA sequence for LST-sub6-4e.
SEQ ID NO: 189 is the determined cDNA sequence for LST-sub6-4f.
SEQ ID NO: 190 is the determined cDNA sequence for LST-sub6-3h.
SEQ ID NO: 191 is the determined cDNA sequence for LST-sub6-5d.
SEQ ID NO: 192 is the determined cDNA sequence for LST-sub6-5h.
SEQ ID NO: 193 is the determined cDNA sequence for LST-sub6-6h.
SEQ ID NO: 194 is the determined cDNA sequence for LST-sub6-7a.
SEQ ID NO: 195 is the determined cDNA sequence for LST-sub6-8a.
SEQ ID NO: 196 is the determined cDNA sequence for LST-sub6-7d.
SEQ ID NO: 197 is the determined cDNA sequence for LST-sub6-7e.
SEQ ID NO: 198 is the determined cDNA sequence for LST-sub6-8e.
SEQ ID NO: 199 is the determined cDNA sequence for LST-sub6-7g.
SEQ ID NO: 200 is the determined cDNA sequence for LST-sub6-9f.
SEQ ID NO: 201 is the determined cDNA sequence for LST-sub6-9h.
SEQ ID NO: 202 is the determined cDNA sequence for LST-sub6-11b.
SEQ ID NO: 203 is the determined cDNA sequence for LST-sub6-11c.
SEQ ID NO: 204 is the determined cDNA sequence for LST-sub6-12c.
SEQ ID NO: 205 is the determined cDNA sequence for LST-sub6-12e.
SEQ ID NO: 206 is the determined cDNA sequence for LST-sub6-12f.
SEQ ID NO: 207 is the determined cDNA sequence for LST-sub6-11g.
SEQ ID NO: 208 is the determined cDNA sequence for LST-sub6-12g.
SEQ ID NO: 209 is the determined cDNA sequence for LST-sub6-12h.
SEQ ID NO: 210 is the determined cDNA sequence for LST-sub6-II-1a.
SEQ ID NO: 211 is the determined cDNA sequence for LST-sub6-II-2b.
SEQ ID NO: 212 is the determined cDNA sequence for LST-sub6-II-2g.
SEQ ID NO: 213 is the determined cDNA sequence for LST-sub6-II-1h.
SEQ ID NO: 214 is the determined cDNA sequence for LST-sub6-II-4a.
SEQ ID NO: 215 is the determined cDNA sequence for LST-sub6-II-4b.
SEQ ID NO: 216 is the determined cDNA sequence for LST-sub6-II-3e.
SEQ ID NO: 217 is the determined cDNA sequence for LST-sub6-II-4f.
SEQ ID NO: 218 is the determined cDNA sequence for LST-sub6-II-4g.
SEQ ID NO: 219 is the determined cDNA sequence for LST-sub6-II-4h.
SEQ ID NO: 220 is the determined cDNA sequence for LST-sub6-II-5c.
SEQ ID NO: 221 is the determined cDNA sequence for LST-sub6-II-5e.
SEQ ID NO: 222 is the determined cDNA sequence for LST-sub6-II-6f.
SEQ ID NO: 223 is the determined cDNA sequence for LST-sub6-II-5g.
SEQ ID NO: 224 is the determined cDNA sequence for LST-sub6-II-6g.
SEQ ID NO: 225 is the amino acid sequence for L528S.
SEQ ID NO: 226-251 are synthetic peptides derived from L762P.
SEQ ID NO: 252 is the expressed amino acid sequence of L514S.
SEQ ID NO: 253 is the DNA sequence corresponding to SEQ ID NO: 252.
SEQ ID NO: 254 is the DNA sequence of a L762P expression construct.
SEQ ID NO: 255 is the determined cDNA sequence for clone 23785.
SEQ ID NO: 256 is the determined cDNA sequence for clone 23786.
SEQ ID NO: 257 is the determined cDNA sequence for clone 23788.
SEQ ID NO: 258 is the determined cDNA sequence for clone 23790.
SEQ ID NO: 259 is the determined cDNA sequence for clone 23793.
SEQ ID NO: 260 is the determined cDNA sequence for clone 23794.
SEQ ID NO: 261 is the determined cDNA sequence for clone 23795.
SEQ ID NO: 262 is the determined cDNA sequence for clone 23796.
SEQ ID NO: 263 is the determined cDNA sequence for clone 23797.
SEQ ID NO: 264 is the determined cDNA sequence for clone 23798.
SEQ ID NO: 265 is the determined cDNA sequence for clone 23799.
SEQ ID NO: 266 is the determined cDNA sequence for clone 23800.
SEQ ID NO: 267 is the determined cDNA sequence for clone 23802.
SEQ ID NO: 268 is the determined cDNA sequence for clone 23803.
SEQ ID NO: 269 is the determined cDNA sequence for clone 23804.
SEQ ID NO: 270 is the determined cDNA sequence for clone 23805.

SEQ ID NO: 271 is the determined cDNA sequence for clone 23806.
SEQ ID NO: 272 is the determined cDNA sequence for clone 23807.
SEQ ID NO: 273 is the determined cDNA sequence for clone 23808.
SEQ ID NO: 274 is the determined cDNA sequence for clone 23809.
SEQ ID NO: 275 is the determined cDNA sequence for clone 23810.
SEQ ID NO: 276 is the determined cDNA sequence for clone 23811.
SEQ ID NO: 277 is the determined cDNA sequence for clone 23812.
SEQ ID NO: 278 is the determined cDNA sequence for clone 23813.
SEQ ID NO: 279 is the determined cDNA sequence for clone 23815.
SEQ ID NO: 280 is the determined cDNA sequence for clone 25298.
SEQ ID NO: 281 is the determined cDNA sequence for clone 25299.
SEQ ID NO: 282 is the determined cDNA sequence for clone 25300.
SEQ ID NO: 283 is the determined cDNA sequence for clone 25301
SEQ ID NO: 284 is the determined cDNA sequence for clone 25304
SEQ ID NO: 285 is the determined cDNA sequence for clone 25309.
SEQ ID NO: 286 is the determined cDNA sequence for clone 25312.
SEQ ID NO: 287 is the determined cDNA sequence for clone 25317.
SEQ ID NO:288 is the determined cDNA sequence for clone 25321.
SEQ ID NO:289 is the determined cDNA sequence for clone 25323.
SEQ ID NO:290 is the determined cDNA sequence for clone 25327.
SEQ ID NO:291 is the determined cDNA sequence for clone 25328.
SEQ ID NO:292 is the determined cDNA sequence for clone 25332.
SEQ ID NO:293 is the determined cDNA sequence for clone 25333.
SEQ ID NO:294 is the determined cDNA sequence for clone 25336.
SEQ ID NO:295 is the determined cDNA sequence for clone 25340.
SEQ ID NO:296 is the determined cDNA sequence for clone 25342.
SEQ ID NO:297 is the determined cDNA sequence for clone 25356.
SEQ ID NO:298 is the determined cDNA sequence for clone 25357.
SEQ ID NO:299 is the determined cDNA sequence for clone 25361.
SEQ ID NO:300 is the determined cDNA sequence for clone 25363.
SEQ ID NO:301 is the determined cDNA sequence for clone 25397.
SEQ ID NO:302 is the determined cDNA sequence for clone 25402.
SEQ ID NO:303 is the determined cDNA sequence for clone 25403.
SEQ ID NO:304 is the determined cDNA sequence for clone 25405.
SEQ ID NO:305 is the determined cDNA sequence for clone 25407.
SEQ ID NO:306 is the determined cDNA sequence for clone 25409.
SEQ ID NO:307 is the determined cDNA sequence for clone 25396.
SEQ ID NO:308 is the determined cDNA sequence for clone 25414.
SEQ ID NO:309 is the determined cDNA sequence for clone 25410.
SEQ ID NO:310 is the determined cDNA sequence for clone 25406.
SEQ ID NO:311 is the determined cDNA sequence for clone 25306.
SEQ ID NO:312 is the determined cDNA sequence for clone 25362.
SEQ ID NO:313 is the determined cDNA sequence for clone 25360.
SEQ ID NO:314 is the determined cDNA sequence for clone 25398.
SEQ ID NO:315 is the determined cDNA sequence for clone 25355.
SEQ ID NO:316 is the determined cDNA sequence for clone 25351.
SEQ ID NO:317 is the determined cDNA sequence for clone 25331.
SEQ ID NO:318 is the determined cDNA sequence for clone 25338.
SEQ ID NO:319 is the determined cDNA sequence for clone 25335.
SEQ ID NO:320 is the determined cDNA sequence for clone 25329.
SEQ ID NO:321 is the determined cDNA sequence for clone 25324.
SEQ ID NO:322 is the determined cDNA sequence for clone 25322.
SEQ ID NO:323 is the determined cDNA sequence for clone 25319.
SEQ ID NO:324 is the determined cDNA sequence for clone 25316.
SEQ ID NO:325 is the determined cDNA sequence for clone 25311.
SEQ ID NO:326 is the determined cDNA sequence for clone 25310.
SEQ ID NO:327 is the determined cDNA sequence for clone 25302.
SEQ ID NO:328 is the determined cDNA sequence for clone 25315.
SEQ ID NO:329 is the determined cDNA sequence for clone 25308.
SEQ ID NO:330 is the determined cDNA sequence for clone 25303.
SEQ ID NO:331-337 are the cDNA sequences of isoforms of the p53 tumor suppressor homologue, p63 (also referred to as L530S).
SEQ ID NO:338-344 are the amino acid sequences encoded by SEQ ID NO:331-337, respectively
SEQ ID NO:345 is a second cDNA sequence for the antigen L763P.
SEQ ID NO:346 is the amino acid sequence encoded by the sequence of SEQ ID NO: 345.
SEQ ID NO:347 is a determined full-length cDNA sequence for L523S.
SEQ ID NO:348 is the amino acid sequence encoded by SEQ ID NO: 347.

SEQ ID NO:349 is the cDNA sequence encoding the N-terminal portion of L773P.

SEQ ID NO:350 is the amino acid sequence of the N-terminal portion of L773P.

SEQ ID NO:351 is the DNA sequence for a fusion of Ra12 and the N-terminal portion of L763P.

SEQ ID NO:352 is the amino acid sequence of the fusion of Ra12 and the N-terminal portion of L763P.

SEQ ID NO:353 is the DNA sequence for a fusion of Ra12 and the C-terminal portion of L763P.

SEQ ID NO:354 is the amino acid sequence of the fusion of Ra12 and the C-terminal portion of L763P.

SEQ ID NO:355 is a primer.

SEQ ID NO:356 is a primer.

SEQ ID NO:357 is the protein sequence of expressed recombinant L762P.

SEQ ID NO:358 is the DNA sequence of expressed recombinant L762P.

SEQ ID NO:359 is a primer.

SEQ ID NO:360 is a primer.

SEQ ID NO:361 is the protein sequence of expressed recombinant L773P A.

SEQ ID NO:362 is the DNA sequence of expressed recombinant L773P A.

SEQ ID NO:363 is an epitope derived from clone L773P polypeptide.

SEQ ID NO:364 is a polynucleotide encoding the polypeptide of SEQ ID NO:363.

SEQ ID NO:365 is an epitope derived from clone L773P polypeptide.

SEQ ID NO:366 is a polynucleotide encoding the polypeptide of SEQ ID NO:365.

SEQ ID NO:367 is an epitope consisting of amino acids 571-590 of SEQ ID NO:161, clone L762P.

SEQ ID NO:368 is the full-length DNA sequence for contig 13 (SEQ ID NO:125), also referred to as L761P.

SEQ ID NO:369 is the protein sequence encoded by the DNA sequence of SEQ ID NO:368.

SEQ ID NO:370 is an L762P DNA sequence from nucleotides 2071-2130.

SEQ ID NO:371 is an L762P DNA sequence from nucleotides 1441-1500.

SEQ ID NO:372 is an L762P DNA sequence from nucleotides 1936-1955.

SEQ ID NO:373 is an L762P DNA sequence from nucleotides 2620-2679.

SEQ ID NO:374 is an L762P DNA sequence from nucleotides 1801-1860.

SEQ ID NO:375 is an L762P DNA sequence from nucleotides 1531-1591.

SEQ ID NO:376 is the amino acid sequence of the L762P peptide encoded by SEQ ID NO:373.

SEQ ID NO:377 is the amino acid sequence of the L762P peptide encoded by SEQ ID NO:370.

SEQ ID NO:378 is the amino acid sequence of the L762P peptide encoded by SEQ ID NO:372.

SEQ ID NO:379 is the amino acid sequence of the L762P peptide encoded by SEQ ID NO:374.

SEQ ID NO:380 is the amino acid sequence of the L762P peptide encoded by SEQ ID NO:371.

SEQ ID NO:381 is the amino acid sequence of the L762P peptide encoded by SEQ ID NO:375.

SEQ ID NO:382 is the amino acid sequence of an epitope of L762P.

SEQ ID NO:383-386 are PCR primers.

SEQ ID NO:387-395 are the amino acid sequences of L773P peptides.

SEQ ID NO:396-419 are the amino acid sequences of L523S peptides.

SEQ ID NO:420 is the determined cDNA sequence for clone #19014.

SEQ ID NO:421 is the forward primer PDM-278 for the L514s-13160 coding region.

SEQ ID NO:422 is the reverse primer PDM-278 for the L514S-13160 coding region.

SEQ ID NO:423 is the amino acid sequence for the expressed recombinant L514S.

SEQ ID NO:424 is the DNA coding sequence for the recombinant L514S.

SEQ ID NO:425 is the forward primer PDM-414 for the L523S coding region.

SEQ ID NO:426 is the reverse primer PDM-414 for the L523S coding region.

SEQ ID NO:427 is the amino acid sequence for the expressed recombinant L523S.

SEQ ID NO:428 is the DNA coding sequence for the recombinant L523S.

SEQ ID NO:429 is the reverse primer PDM-279 for the L762PA coding region.

SEQ ID NO:430 is the amino acid sequence of the expressed recombinant L762PA.

SEQ ID NO:431 is the DNA coding sequence for the recombinant L762PA.

SEQ ID NO:432 is the reverse primer PDM-300 for the L773P coding region.

SEQ ID NO:433 is the amino acid sequence of the expressed recombinant L773P.

SEQ ID NO:434 is the DNA coding sequence for the recombinant L773P.

SEQ ID NO:435 is the forward primer for TCR Valpha8.

SEQ ID NO:436 is the reverse primer for TCR Valpha8.

SEQ ID NO:437 is the forward primer for TCR Vbeta8.

SEQ ID NO:438 is the reverse primer for TCR Vbeta8.

SEQ ID NO:439 is the TCR Valpha DNA sequence of the TCR clone specific for the lung antigen L762P.

SEQ ID NO:440 is the TCR Vbeta DNA sequence of the TCR clone specific for the lung antigen L762P.

SEQ ID NO:441 is the amino acid sequence of L763 peptide #2684.

SEQ ID NO:442 is the predicted full-length cDNA for the cloned partial sequence of clone L529S (SEQ ID NO:106).

SEQ ID NO:443 is the deduced amino acid sequence encoded by SEQ ID NO:442.

SEQ ID NO:444 is the forward primer PDM-734 for the coding region of clone L523S.

SEQ ID NO:445 is the reverse primer PDM-735 for the coding region of clone L523S.

SEQ ID NO:446 is the amino acid sequence for the expressed recombinant L523S.

SEQ ID NO:447 is the DNA coding sequence for the recombinant L523S.

SEQ ID NO:448 is another forward primer PDM-733 for the coding region of clone L523S.

SEQ ID NO:449 is the amino acid sequence for a second expressed recombinant L523S.

SEQ ID NO:450 is the DNA coding sequence for a second recombinant L523S.

SEQ ID NO:451 corresponds to amino acids 86-110, an epitope of L514S-specific in the generation of antibodies.

SEQ ID NO:452 corresponds to amino acids 21-45, an epitope of L514S-specific in the generation of antibodies.

SEQ ID NO:453 corresponds to amino acids 121-135, an epitope of L514S-specific in the generation of antibodies.

SEQ ID NO:454 corresponds to amino acids 440-460, an epitope of L523S-specific in the generation of antibodies.

SEQ ID NO:455 corresponds to amino acids 156-175, an epitope of L523S-specific in the generation of antibodies.

SEQ ID NO:456 corresponds to amino acids 326-345, an epitope of L523S-specific in the generation of antibodies.

SEQ ID NO:457 corresponds to amino acids 40-59, an epitope of L523S-specific in the generation of antibodies.

SEQ ID NO:458 corresponds to amino acids 80-99, an epitope of L523S-specific in the generation of antibodies.

SEQ ID NO:459 corresponds to amino acids 160-179, an epitope of L523S-specific in the generation of antibodies.

SEQ ID NO:460 corresponds to amino acids 180-199, an epitope of L523S-specific in the generation of antibodies.

SEQ ID NO:461 corresponds to amino acids 320-339, an epitope of L523S-specific in the generation of antibodies.

SEQ ID NO:462 corresponds to amino acids 340-359, an epitope of L523S-specific in the generation of antibodies.

SEQ ID NO:463 corresponds to amino acids 370-389, an epitope of L523S-specific in the generation of antibodies.

SEQ ID NO:464 corresponds to amino acids 380-399, an epitope of L523S-specific in the generation of antibodies.

SEQ ID NO:465 corresponds to amino acids 37-55, an epitope of L523S-recognized by the L523S-specific CTL line 6B1.

SEQ ID NO:466 corresponds to amino acids 41-51, the mapped antigenic epitope of L523S-recognized by the L523S-specific CTL line 6B1.

SEQ ID NO:467 corresponds to the DNA sequence which encodes SEQ ID NO:466.

SEQ ID NO:468 corresponds to the amino acids of peptide 16, 17 of hL523S.

SEQ ID NO:469 corresponds to the amino acids of peptide 16, 17 of mL523S.

SEQ ID NO:470 corresponds to the amino acids of the 20-mer peptide #4 of L523S.

SEQ ID NO:471 corresponds to the amino acids of the overlapping 20-mer peptides #14-#19 of L523S.

SEQ ID NO:472 corresponds to the amino acids of the overlapping 20-mer peptides #20-#25 of L523S.

SEQ ID NO:473 corresponds to the amino acids of the overlapping 20-mer peptides #26-#30.5 of L523S.

SEQ ID NO:474 corresponds to the amino acids of the overlapping 20-mer peptides #31-#36 of L523S.

SEQ ID NO:475 corresponds to the amino acids of the overlapping 20-mer peptides #37-#40.5 of L523S.

SEQ ID NO:476 corresponds to the amino acids of the overlapping 20-mer peptides #41-#46.5 of L523S.

SEQ ID NO:477 corresponds to the amino acids of the overlapping 20-mer peptides #47-#53 of L523S.

SEQ ID NO:478 is the cDNA encoding the full length ORF of L523S.

SEQ ID NO:479 is the cDNA sequence of Adenovirus-L523s, an Adenovirus vector containing the cDNA encoding the full-length ORF of L523S.

SEQ ID NO:480 is the amino acid sequence of the full-length L523S protein as expressed from the Adenovirus vector set forth in SEQ ID NO:479.

SEQ ID NO:481 is amino acids 9-27 of L523S containing a CD8 T cell epitope as described in example 37.

SEQ ID NO:482 is amino acids 33-75 of L523S containing a CD4 T cell epitope as described in example 37.

SEQ ID NO:483 is the determined cDNA sequence for the Rhesus macaque L523S homologue.

SEQ ID NO:484 is the predicted amino acid sequence for the Rhesus macaque L523S homologue, encoded by the polynucleotide sequence set forth in SEQ ID NO:483.

SEQ ID NO:485 is the full-length L523S cDNA, together with its Kozak consensus sequence and a C-terminal 10× His Tag for expression in insect cells using a baculovirus system.

SEQ ID NO:486 is the full-length L523S amino acid sequence encoded by the polynucleotide set forth in SEQ ID NO:485.

SEQ ID NO:487 is the L523F1 PCR primer.

SEQ ID NO:488 is the L523RV1 PCR primer.

SEQ ID NO:489 is the cDNA encoding the minimal epitope of L514S set forth in SEQ ID NO:490.

SEQ ID NO:490 is the amino acid sequence of peptide #10 minimal epitope of L514S.

SEQ ID NO:491 is a minimal 9-mer CTL epitope of L523S.

SEQ ID NO:492 is the amino acid sequence of peptide #2 of NY-ESO-1.

SEQ ID NO:493 is the amino acid sequence of peptide #3 of NY-ESO-1.

SEQ ID NO:494 is the amino acid sequence of peptide #10 of NY-ESO-1.

SEQ ID NO:495 is the amino acid sequence of peptide #17 of NY-ESO-1.

SEQ ID NO:496 is the amino acid sequence of peptide #5 of NY-ESO-1.

SEQ ID NO:497 is the amino acid sequence of peptide #42 of L523S.

SEQ ID NO:498 is the amino acid sequence of IMP-1 peptide #42.

SEQ ID NO:499 is the amino acid sequence of IMP-2 peptide #42.

SEQ ID NO:500 is the amino acid sequence of IMP-1.

SEQ ID NO:501 is the amino acid sequence of IMP-2.

SEQ ID NO:502 is the amino acid sequence of IMP-1 peptide #32.

SEQ ID NO:503 is the amino acid sequence of IMP-2 peptide #32.

SEQ ID NO:504 is the amino acid sequence of peptide #1 of L523S.

SEQ ID NO:505 is the amino acid sequence of peptide #2 of L523S.

SEQ ID NO:506 is the amino acid sequence of peptide #3 of L523S.

SEQ ID NO:507 is the amino acid sequence of peptide #4 of L523S.

SEQ ID NO:508 is the amino acid sequence of peptide #5 of L523S.

SEQ ID NO:509 is the amino acid sequence of peptide #6 of L523S.

SEQ ID NO:510 is the amino acid sequence of peptide #7 of L523S.

SEQ ID NO:511 is the amino acid sequence of peptide #8 of L523S.

SEQ ID NO:512 is the amino acid sequence of peptide #9 of L523S.

SEQ ID NO:513 is the amino acid sequence of peptide #10 of L523S.

SEQ ID NO:514 is the amino acid sequence of peptide #11 of L523S.

SEQ ID NO:515 is the amino acid sequence of peptide #12 of L523S.

SEQ ID NO:516 is the amino acid sequence of peptide #13 of L523S.

SEQ ID NO:517 is the amino acid sequence of peptide #14 of L523S.

SEQ ID NO:518 is the amino acid sequence of peptide #15 of L523S.

SEQ ID NO:519 is the amino acid sequence of peptide #16 of L523S.

SEQ ID NO:520 is the amino acid sequence of peptide #17 of L523S.

SEQ ID NO:521 is the amino acid sequence of peptide #18 of L523S.

SEQ ID NO:522 is the amino acid sequence of peptide #19 of L523S.

SEQ ID NO:523 is the amino acid sequence of peptide #20 of L523S.

SEQ ID NO:524 is the amino acid sequence of peptide #21 of L523S.

SEQ ID NO:525 is the amino acid sequence of peptide #22 of L523S.

SEQ ID NO:526 is the amino acid sequence of peptide #23 of L523S.

SEQ ID NO:527 is the amino acid sequence of peptide #24 of L523S.

SEQ ID NO:528 is the amino acid sequence of peptide #25 of L523S.

SEQ ID NO:529 is the amino acid sequence of peptide #26 of L523S.

SEQ ID NO:530 is the amino acid sequence of peptide #27 of L523S.

SEQ ID NO:531 is the amino acid sequence of peptide #28 of L523S.

SEQ ID NO:532 is the amino acid sequence of peptide #29 of L523S.

SEQ ID NO:533 is the amino acid sequence of peptide #30 of L523S.

SEQ ID NO:534 is the amino acid sequence of peptide #30.5 of L523S.

SEQ ID NO:535 is the amino acid sequence of peptide #31 of L523S.

SEQ ID NO:536 is the amino acid sequence of peptide #32 of L523S.

SEQ ID NO:537 is the amino acid sequence of peptide #33 of L523S.

SEQ ID NO:538 is the amino acid sequence of peptide #34 of L523S.

SEQ ID NO:539 is the amino acid sequence of peptide #35 of L523S.

SEQ ID NO:540 is the amino acid sequence of peptide #36 of L523S.

SEQ ID NO:541 is the amino acid sequence of peptide #37 of L523S.

SEQ ID NO:542 is the amino acid sequence of peptide #38 of L523S.

SEQ ID NO:543 is the amino acid sequence of peptide #38.5 of L523S.

SEQ ID NO:544 is the amino acid sequence of peptide #39 of L523S.

SEQ ID NO:545 is the amino acid sequence of peptide #40 of L523S.

SEQ ID NO:546 is the amino acid sequence of peptide #40.5 of L523S.

SEQ ID NO:547 is the amino acid sequence of peptide #41 of L523S.

SEQ ID NO:548 is the amino acid sequence of peptide #42 of L523S.

SEQ ID NO:549 is the amino acid sequence of peptide #43 of L523S.

SEQ ID NO:550 is the amino acid sequence of peptide #44 of L523S.

SEQ ID NO:551 is the amino acid sequence of peptide #45 of L523S.

SEQ ID NO:552 is the amino acid sequence of peptide #46 of L523S.

SEQ ID NO:553 is the amino acid sequence of peptide #46.5 of L523S.

SEQ ID NO:554 is the amino acid sequence of peptide #47 of L523S.

SEQ ID NO:555 is the amino acid sequence of peptide #48 of L523S.

SEQ ID NO:556 is the amino acid sequence of peptide #49 of L523S.

SEQ ID NO:557 is the amino acid sequence of peptide #50 of L523S.

SEQ ID NO:558 is the amino acid sequence of peptide #51 of L523S.

SEQ ID NO:559 is the amino acid sequence of peptide #52 of L523S.

SEQ ID NO:560 is the amino acid sequence of peptide #53 of L523S.

DETAILED DESCRIPTION OF THE INVENTION

U.S. patents, U.S. patent application publications, U.S. patent applications, foreign patents, foreign patent applications and non-patent publications referred to in this specification and/or listed in the Application Data Sheet, are incorporated herein by reference, in their entirety.

The present invention is directed generally to compositions and their use in the therapy and diagnosis of cancer, particularly lung cancer. As described further below, illustrative compositions of the present invention include, but are not restricted to, polypeptides, particularly immunogenic polypeptides, polynucleotides encoding such polypeptides, antibodies and other binding agents, antigen presenting cells (APCs) and immune system cells (e.g., T cells).

The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., Sambrook, et al. Molecular Cloning: A Laboratory Manual (2nd Edition, 1989); Maniatis et al. Molecular Cloning: A Laboratory Manual (1982); DNA Cloning: A Practical Approach, vol. I & II (D. Glover, ed.); Oligonucleotide Synthesis (N. Gait, ed., 1984); Nucleic Acid Hybridization (B. Hames & S. Higgins, eds., 1985); Transcription and Translation (B. Hames & S. Higgins, eds., 1984); Animal Cell Culture (R. Freshney, ed., 1986); Perbal, A Practical Guide to Molecular Cloning (1984).

All publications, patents and patent applications cited herein, whether supra or infra, are hereby incorporated by reference in their entirety.

As used in this specification and the appended claims, the singular forms "a," "an" and "the" include plural references unless the content clearly dictates otherwise.

Polypeptide Compositions

As used herein, the term "polypeptide" is used in its conventional meaning, i.e., as a sequence of amino acids. The polypeptides are not limited to a specific length of the product; thus, peptides, oligopeptides, and proteins are included within the definition of polypeptide, and such terms may be used interchangeably herein unless specifically indicated otherwise. This term also does not refer to or exclude post-expression modifications of the polypeptide, for example, glycosylations, acetylations, phosphorylations and the like, as well as other modifications known in the art, both naturally occurring and non-naturally occurring. A polypeptide may be an entire protein, or a subsequence thereof. Particular polypeptides of interest in the context of this invention are amino acid subsequences comprising epitopes, i.e., antigenic determinants substantially responsible for the immunogenic properties of a polypeptide and being capable of evoking an immune response.

Particularly illustrative polypeptides of the present invention comprise those encoded by a polynucleotide sequence set forth in any one of SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479 and 483, or a sequence that hybridizes under moderately stringent conditions, or, alternatively, under highly stringent conditions, to a polynucleotide sequence set forth in any one of SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479 and 483. Certain illustrative polypeptides of the invention comprise amino acid sequences as set forth in any one of SEQ ID NO:152, 155, 156, 165, 166, 169, 170, 172, 174, 176, 226-252, 338-344, 346, 350, 357, 361, 363, 365, 367, 369, 376-382, 387-419, 423, 427, 430, 433, 441, 443, 446, 449, 451-466, 468-477, 480-482, and 484.

The polypeptides of the present invention are sometimes herein referred to as lung tumor proteins or lung tumor polypeptides, as an indication that their identification has been based at least in part upon their increased levels of expression in lung tumor samples. Thus, a "lung tumor polypeptide" or "lung tumor protein," refers generally to a polypeptide sequence of the present invention, or a polynucleotide sequence encoding such a polypeptide, that is expressed in a substantial proportion of lung tumor samples, for example preferably greater than about 20%, more preferably greater than about 30%, and most preferably greater than about 50% or more of lung tumor samples tested, at a level that is at least two fold, and preferably at least five fold, greater than the level of expression in normal tissues, as determined using a representative assay provided herein. A lung tumor polypeptide sequence of the invention, based upon its increased level of expression in tumor cells, has particular utility both as a diagnostic marker as well as a therapeutic target, as further described below.

In certain preferred embodiments, the polypeptides of the invention are immunogenic, i.e., they react detectably within an immunoassay (such as an ELISA or T-cell stimulation assay) with antisera and/or T-cells from a patient with lung cancer. Screening for immunogenic activity can be performed using techniques well known to the skilled artisan. For example, such screens can be performed using methods such as those described in Harlow and Lane, *Antibodies: A Laboratory Manual*, Cold Spring Harbor Laboratory, 1988. In one illustrative example, a polypeptide may be immobilized on a solid support and contacted with patient sera to allow binding of antibodies within the sera to the immobilized polypeptide. Unbound sera may then be removed and bound antibodies detected using, for example, $^{125}$I-labeled Protein A.

As would be recognized by the skilled artisan, immunogenic portions of the polypeptides disclosed herein are also encompassed by the present invention. An "immunogenic portion," as used herein, is a fragment of an immunogenic polypeptide of the invention that itself is immunologically reactive (i.e., specifically binds) with the B-cells and/or T-cell surface antigen receptors that recognize the polypeptide. Immunogenic portions may generally be identified using well known techniques, such as those summarized in Paul, *Fundamental Immunology*, 3rd ed., 243-247 (Raven Press, 1993) and references cited therein. Such techniques include screening polypeptides for the ability to react with antigen-specific antibodies, antisera and/or T-cell lines or clones. As used herein, antisera and antibodies are "antigen-specific" if they specifically bind to an antigen (i.e., they react with the protein in an ELISA or other immunoassay, and do not react detectably with unrelated proteins). Such antisera and antibodies may be prepared as described herein, and using well-known techniques.

In one preferred embodiment, an immunogenic portion of a polypeptide of the present invention is a portion that reacts with antisera and/or T-cells at a level that is not substantially less than the reactivity of the full-length polypeptide (e.g., in an ELISA and/or T-cell reactivity assay). Preferably, the level of immunogenic activity of the immunogenic portion is at least about 50%, preferably at least about 70% and most preferably greater than about 90% of the immunogenicity for the full-length polypeptide. In some instances, preferred immunogenic portions will be identified that have a level of immunogenic activity greater than that of the corresponding full-length polypeptide, e.g., having greater than about 100% or 150% or more immunogenic activity.

In certain other embodiments, illustrative immunogenic portions may include peptides in which an N-terminal leader sequence and/or transmembrane domain have been deleted. Other illustrative immunogenic portions will contain a small N- and/or C-terminal deletion (e.g., 1-30 amino acids, preferably 5-15 amino acids), relative to the mature protein.

In another embodiment, a polypeptide composition of the invention may also comprise one or more polypeptides that are immunologically reactive with T cells and/or antibodies generated against a polypeptide of the invention, particularly a polypeptide having an amino acid sequence disclosed herein, or to an immunogenic fragment or variant thereof.

In another embodiment of the invention, polypeptides are provided that comprise one or more polypeptides that are capable of eliciting T cells and/or antibodies that are immunologically reactive with one or more polypeptides described herein, or one or more polypeptides encoded by contiguous nucleic acid sequences contained in the polynucleotide sequences disclosed herein, or immunogenic fragments or variants thereof, or to one or more nucleic acid sequences which hybridize to one or more of these sequences under conditions of moderate to high stringency.

The present invention, in another aspect, provides polypeptide fragments comprising at least about 5, 10, 15, 20, 25, 50, or 100 contiguous amino acids, or more, including all intermediate lengths, of a polypeptide compositions set forth herein, such as those set forth in SEQ ID NO:152, 155, 156, 165, 166, 169, 170, 172, 174, 176, 226-252, 338-344, 346, 350, 357, 361, 363, 365, 367, 369, 376-382 and 387-419, 441, 443, 446, 449, 451-466, 468-477, 480-482, and 484, or those encoded by a polynucleotide sequence set forth in a sequence of SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479 and 483.

In another aspect, the present invention provides variants of the polypeptide compositions described herein. Polypeptide variants generally encompassed by the present invention will typically exhibit at least about 70%, 75%, 80%, 85%, 90%, 91%, 92%, 93%, 94%, 95%, 96%, 97%, 98%, or 99% or more identity (determined as described below), along its length, to a polypeptide sequences set forth herein.

In one preferred embodiment, the polypeptide fragments and variants provide by the present invention are immunologically reactive with an antibody and/or T-cell that reacts with a full-length polypeptide specifically set for the herein.

In another preferred embodiment, the polypeptide fragments and variants provided by the present invention exhibit a level of immunogenic activity of at least about 50%, preferably at least about 70%, and most preferably at least about 90% or more of that exhibited by a full-length polypeptide sequence specifically set forth herein.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating their immunogenic activity as described herein and/or using any of a number of techniques well known in the art.

For example, certain illustrative variants of the polypeptides of the invention include those in which one or more portions, such as an N-terminal leader sequence or transmembrane domain, have been removed. Other illustrative variants include variants in which a small portion (e.g., 1-30 amino acids, preferably 5-15 amino acids) has been removed from the N- and/or C-terminal of the mature protein.

In many instances, a variant will contain conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged. As described above, modifications may be made in the structure of the polynucleotides and polypeptides of the present invention and still obtain a functional molecule that encodes a variant or derivative polypeptide with desirable characteristics, e.g., with immunogenic characteristics. When it is desired to alter the amino acid sequence of a polypeptide to create an equivalent, or even an improved, immunogenic variant or portion of a polypeptide of the invention, one skilled in the art will typically change one or more of the codons of the encoding DNA sequence according to Table 1.

For example, certain amino acids may be substituted for other amino acids in a protein structure without appreciable loss of interactive binding capacity with structures such as, for example, antigen-binding regions of antibodies or binding sites on substrate molecules. Since it is the interactive capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated that various changes may be made in the peptide sequences of the disclosed compositions, or corresponding DNA sequences which encode said peptides without appreciable loss of their biological utility or activity.

TABLE I

| Amino Acids | | | Codons |
|---|---|---|---|
| Alanine | Ala | A | GCA GCC GCG GCU |
| Cysteine | Cys | C | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

In making such changes, the hydropathic index of amino acids may be considered. The importance of the hydropathic amino acid index in conferring interactive biologic function on a protein is generally understood in the art (Kyte and Doolittle, 1982, incorporated herein by reference). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity. U.S. Pat. No. 4,554,101 (specifically incorporated herein by reference in its entirety), states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

In addition, any polynucleotide may be further modified to increase stability in vivo. Possible modifications include, but are not limited to, the addition of flanking sequences at the 5' and/or 3' ends; the use of phosphorothioate or 2' O-methyl rather than phosphodiesterase linkages in the backbone; and/or the inclusion of nontraditional bases such as inosine, queosine and wybutosine, as well as acetyl-methyl-, thio- and other modified forms of adenine, cytidine, guanine, thymine and uridine.

Amino acid substitutions may further be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gin, asn, ser, thr; (2) cys, ser, tyr, thr; (3) val, ile, leu, met, ala, phe; (4) lys, arg, his; and (5) phe, tyr, trp, his. A variant may also, or alternatively, contain non-conservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

As noted above, polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

When comparing polypeptide sequences, two sequences are said to be "identical" if the sequence of amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) *CABIOS* 5:151-153; Myers, E. W. and Muller W. (1988) *CABIOS* 4:11-17; Robinson, E. D. (1971) *Comb. Theor* 11:105; Santou, N. Nes, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389-3402 and Altschul et al. (1990) *J. Mol. Biol.* 215:403-410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information. For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments;

or the end of either sequence is reached. The BLAST algorithm parameters W, T and X determine the sensitivity and speed of the alignment.

In one preferred approach, the "percentage of sequence identity" is determined by comparing two optimally aligned sequences over a window of comparison of at least 20 positions, wherein the portion of the polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical amino acid residue occurs in both sequences to yield the number of matched positions, dividing the number of matched positions by the total number of positions in the reference sequence (i.e., the window size) and multiplying the results by 100 to yield the percentage of sequence identity.

Within other illustrative embodiments, a polypeptide may be a fusion polypeptide that comprises multiple polypeptides as described herein, or that comprises at least one polypeptide as described herein and an unrelated sequence, such as a known tumor protein. A fusion partner may, for example, assist in providing T helper epitopes (an immunological fusion partner), preferably T helper epitopes recognized by humans, or may assist in expressing the protein (an expression enhancer) at higher yields than the native recombinant protein. Certain preferred fusion partners are both immunological and expression enhancing fusion partners. Other fusion partners may be selected so as to increase the solubility of the polypeptide or to enable the polypeptide to be targeted to desired intracellular compartments. Still further fusion partners include affinity tags, which facilitate purification of the polypeptide.

Fusion polypeptides may generally be prepared using standard techniques, including chemical conjugation. Preferably, a fusion polypeptide is expressed as a recombinant polypeptide, allowing the production of increased levels, relative to a non-fused polypeptide, in an expression system. Briefly, DNA sequences encoding the polypeptide components may be assembled separately, and ligated into an appropriate expression vector. The 3' end of the DNA sequence encoding one polypeptide component is ligated, with or without a peptide linker, to the 5' end of a DNA sequence encoding the second polypeptide component so that the reading frames of the sequences are in phase. This permits translation into a single fusion polypeptide that retains the biological activity of both component polypeptides.

A peptide linker sequence may be employed to separate the first and second polypeptide components by a distance sufficient to ensure that each polypeptide folds into its secondary and tertiary structures. Such a peptide linker sequence is incorporated into the fusion polypeptide using standard techniques well known in the art. Suitable peptide linker sequences may be chosen based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. Preferred peptide linker sequences contain Gly, Asn and Ser residues. Other near neutral amino acids, such as Thr and Ala may also be used in the linker sequence. Amino acid sequences which may be usefully employed as linkers include those disclosed in Maratea et al., *Gene* 40:39-46, 1985; Murphy et al., *Proc. Natl. Acad. Sci. USA* 83:8258-8262, 1986; U.S. Pat. No. 4,935,233 and U.S. Pat. No. 4,751,180. The linker sequence may generally be from 1 to about 50 amino acids in length. Linker sequences are not required when the first and second polypeptides have non-essential N-terminal amino acid regions that can be used to separate the functional domains and prevent steric interference.

The ligated DNA sequences are operably linked to suitable transcriptional or translational regulatory elements. The regulatory elements responsible for expression of DNA are located only 5' to the DNA sequence encoding the first polypeptides. Similarly, stop codons required to end translation and transcription termination signals are only present 3' to the DNA sequence encoding the second polypeptide.

The fusion polypeptide can comprise a polypeptide as described herein together with an unrelated immunogenic protein, such as an immunogenic protein capable of eliciting a recall response. Examples of such proteins include tetanus, tuberculosis and hepatitis proteins (see, for example, Stoute et al. *New Engl. J. Med.*, 336:86-91, 1997).

In one preferred embodiment, the immunological fusion partner is derived from a *Mycobacterium* sp., such as a *Mycobacterium tuberculosis*-derived Ra12 fragment. Ra12 compositions and methods for their use in enhancing the expression and/or immunogenicity of heterologous polynucleotide/polypeptide sequences is described in U.S. Patent Application 60/158,585, the disclosure of which is incorporated herein by reference in its entirety. Briefly, Ra12 refers to a polynucleotide region that is a subsequence of a *Mycobacterium tuberculosis* MTB32A nucleic acid. MTB32A is a serine protease of 32 KD molecular weight encoded by a gene in virulent and avirulent strains of *M. tuberculosis*. The nucleotide sequence and amino acid sequence of MTB32A have been described (for example, U.S. Patent Application 60/158,585; see also, Skeiky et al., *Infection and Immun.* (1999) 67:3998-4007, incorporated herein by reference). C-terminal fragments of the MTB32A coding sequence express at high levels and remain as a soluble polypeptides throughout the purification process. Moreover, Ra12 may enhance the immunogenicity of heterologous immunogenic polypeptides with which it is fused. One preferred Ra12 fusion polypeptide comprises a 14 KD C-terminal fragment corresponding to amino acid residues 192 to 323 of MTB32A.

Other preferred Ra12 polynucleotides generally comprise at least about 15 consecutive nucleotides, at least about 30 nucleotides, at least about 60 nucleotides, at least about 100 nucleotides, at least about 200 nucleotides, or at least about 300 nucleotides that encode a portion of a Ra12 polypeptide.

Ra12 polynucleotides may comprise a native sequence (i.e., an endogenous sequence that encodes a Ra12 polypeptide or a portion thereof) or may comprise a variant of such a sequence. Ra12 polynucleotide variants may contain one or more substitutions, additions, deletions and/or insertions such that the biological activity of the encoded fusion polypeptide is not substantially diminished, relative to a fusion polypeptide comprising a native Ra12 polypeptide. Variants preferably exhibit at least about 70% identity, more preferably at least about 80% identity and most preferably at least about 90% identity to a polynucleotide sequence that encodes a native Ra12 polypeptide or a portion thereof.

Within other preferred embodiments, an immunological fusion partner is derived from protein D, a surface protein of the gram-negative bacterium *Haemophilus influenza* B (WO 91/18926). Preferably, a protein D derivative comprises approximately the first third of the protein (e.g., the first N-terminal 100-110 amino acids), and a protein D derivative may be lipidated. Within certain preferred embodiments, the first 109 residues of a Lipoprotein D fusion partner is included on the N-terminus to provide the polypeptide with additional exogenous T-cell epitopes and to increase the expression level in *E. coli* (thus functioning as an expression enhancer). The lipid tail ensures optimal presentation of the antigen to antigen presenting cells. Other fusion partners include the non-structural protein from influenza virus, NS1 (haemagglutinin). Typically, the N-terminal 81 amino acids are used, although different fragments that include T-helper epitopes may be used.

In another embodiment, the immunological fusion partner is the protein known as LYTA, or a portion thereof (preferably a C-terminal portion). LYTA is derived from *Streptococcus pneumoniae*, which synthesizes an N-acetyl-L-alanine amidase known as amidase LYTA (encoded by the LytA gene; *Gene* 43:265-292, 1986). LYTA is an autolysin that specifically degrades certain bonds in the peptidoglycan backbone. The C-terminal domain of the LYTA protein is responsible for the affinity to the choline or to some choline analogues such as DEAE. This property has been exploited for the development of *E. coli* C-LYTA expressing plasmids useful for expression of fusion proteins. Purification of hybrid proteins containing the C-LYTA fragment at the amino terminus has been described (see *Biotechnology* 10:795-798, 1992). Within a preferred embodiment, a repeat portion of LYTA may be incorporated into a fusion polypeptide. A repeat portion is found in the C-terminal region starting at residue 178. A particularly preferred repeat portion incorporates residues 188-305.

Yet another illustrative embodiment involves fusion polypeptides, and the polynucleotides encoding them, wherein the fusion partner comprises a targeting signal capable of directing a polypeptide to the endosomal/lysosomal compartment, as described in U.S. Pat. No. 5,633,234. An immunogenic polypeptide of the invention, when fused with this targeting signal, will associate more efficiently with MHC class II molecules and thereby provide enhanced in vivo stimulation of CD4$^+$ T-cells specific for the polypeptide.

Polypeptides of the invention are prepared using any of a variety of well known synthetic and/or recombinant techniques, the latter of which are further described below. Polypeptides, portions and other variants generally less than about 150 amino acids can be generated by synthetic means, using techniques well known to those of ordinary skill in the art. In one illustrative example, such polypeptides are synthesized using any of the commercially available solid-phase techniques, such as the Merrifield solid-phase synthesis method, where amino acids are sequentially added to a growing amino acid chain. See Merrifield, *J. Am. Chem. Soc.* 85:2149-2146, 1963. Equipment for automated synthesis of polypeptides is commercially available from suppliers such as Perkin Elmer/Applied BioSystems Division (Foster City, Calif.), and may be operated according to the manufacturer's instructions.

In general, polypeptide compositions (including fusion polypeptides) of the invention are isolated. An "isolated" polypeptide is one that is removed from its original environment. For example, a naturally-occurring protein or polypeptide is isolated if it is separated from some or all of the coexisting materials in the natural system. Preferably, such polypeptides are also purified, e.g., are at least about 90% pure, more preferably at least about 95% pure and most preferably at least about 99% pure.

Polynucleotide Compositions

The present invention, in other aspects, provides polynucleotide compositions. The terms "DNA" and "polynucleotide" are used essentially interchangeably herein to refer to a DNA molecule that has been isolated free of total genomic DNA of a particular species. "Isolated," as used herein, means that a polynucleotide is substantially away from other coding sequences, and that the DNA molecule does not contain large portions of unrelated coding DNA, such as large chromosomal fragments or other functional genes or polypeptide coding regions. Of course, this refers to the DNA molecule as originally isolated, and does not exclude genes or coding regions later added to the segment by the hand of man.

As will be understood by those skilled in the art, the polynucleotide compositions of this invention can include genomic sequences, extra-genomic and plasmid-encoded sequences and smaller engineered gene segments that express, or may be adapted to express, proteins, polypeptides, peptides and the like. Such segments may be naturally isolated, or modified synthetically by the hand of man.

As will be also recognized by the skilled artisan, polynucleotides of the invention may be single-stranded (coding or antisense) or double-stranded, and may be DNA (genomic, cDNA or synthetic) or RNA molecules. RNA molecules may include HnRNA molecules, which contain introns and correspond to a DNA molecule in a one-to-one manner, and mRNA molecules, which do not contain introns. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes a polypeptide/protein of the invention or a portion thereof) or may comprise a sequence that encodes a variant or derivative, preferably and immunogenic variant or derivative, of such a sequence.

Therefore, according to another aspect of the present invention, polynucleotide compositions are provided that comprise some or all of a polynucleotide sequence set forth in any one of SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489, complements of a polynucleotide sequence set forth in any one of SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489, and degenerate variants of a polynucleotide sequence set forth in any one of SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489. In certain preferred embodiments, the polynucleotide sequences set forth herein encode immunogenic polypeptides, as described above.

In other related embodiments, the present invention provides polynucleotide variants having substantial identity to the sequences disclosed herein in SEQ ID NO:1-3, 6-8, 10-13, 15-27, 29, 30, 32, 34-49, 51, 52, 54, 55, 57-59, 61-69, 71, 73, 74, 77, 78, 80-82, 84, 86-96, 107-109, 111, 113, 125, 127, 128, 129, 131-133, 142, 144, 148-151, 153, 154, 157, 158, 160, 167, 168, 171, 179, 182, 184-186, 188-191, 193, 194, 198-207, 209, 210, 213, 214, 217, 220-224, 253-337, 345, 347, 349, 358, 362, 364, 365, 368, 370-375, 420, 424, 428, 431, 434, 442, 447, 450, 467, 478, 479, 483, 485, and 489, for example those comprising at least 70% sequence identity, preferably at least 75%, 80%, 85%, 90%, 95%, 96%, 97%, 98%, or 99% or higher, sequence identity compared to a polynucleotide sequence of this invention using the methods described herein, (e.g., BLAST analysis using standard parameters, as described below). One skilled in this art will recognize that these values can be appropriately adjusted to determine corresponding identity of proteins encoded by two nucleotide sequences by taking into account codon degeneracy, amino acid similarity, reading frame positioning and the like.

Typically, polynucleotide variants will contain one or more substitutions, additions, deletions and/or insertions, preferably such that the immunogenicity of the polypeptide encoded by the variant polynucleotide is not substantially diminished relative to a polypeptide encoded by a polynucleotide sequence specifically set forth herein). The term "variants" should also be understood to encompasses homologous genes of xenogenic origin.

In additional embodiments, the present invention provides polynucleotide fragments comprising various lengths of contiguous stretches of sequence identical to or complementary to one or more of the sequences disclosed herein. For example, polynucleotides are provided by this invention that comprise at least about 10, 15, 20, 30, 40, 50, 75, 100, 150, 200, 300, 400, 500 or 1000 or more contiguous nucleotides of one or more of the sequences disclosed herein as well as all intermediate lengths there between. It will be readily understood that "intermediate lengths", in this context, means any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200-500; 500-1,000, and the like.

In another embodiment of the invention, polynucleotide compositions are provided that are capable of hybridizing under moderate to high stringency conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC, 0.5% SDS, 1.0 mM EDTA (pH 8.0); hybridizing at 50° C.-60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60-65° C. or 65-70° C.

In certain preferred embodiments, the polynucleotides described above, e.g., polynucleotide variants, fragments and hybridizing sequences, encode polypeptides that are immunologically cross-reactive with a polypeptide sequence specifically set forth herein. In other preferred embodiments, such polynucleotides encode polypeptides that have a level of immunogenic activity of at least about 50%, preferably at least about 70%, and more preferably at least about 90% of that for a polypeptide sequence specifically set forth herein.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol. For example, illustrative polynucleotide segments with total lengths of about 10,000, about 5000, about 3000, about 2,000, about 1,000, about 500, about 200, about 100, about 50 base pairs in length, and the like, (including all intermediate lengths) are contemplated to be useful in many implementations of this invention.

When comparing polynucleotide sequences, two sequences are said to be "identical" if the sequence of nucleotides in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) *CABIOS* 5:151-153; Myers, E. W. and Muller W. (1988) *CABIOS* 4:11-17; Robinson, E. D. (1971) *Comb. Theor* 11:105; Santou, N. Nes, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389-3402 and Altschul et al. (1990) *J. Mol. Biol.* 215:403-410, respectively. BLAST and BLAST 2.0 can be used, for example with the parameters described herein, to determine percent sequence identity for the polynucleotides of the invention. Software for performing BLAST analyses is publicly available through the National Center for Biotechnology Information. In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) *Proc. Natl. Acad. Sci. USA* 89:10915) alignments, (B) of 50, expectation (E) of 10, M=5, N=−4 and a comparison of both strands.

Preferably, the "percentage of sequence identity" is determined by comparing two optimally aligned sequences over a window of comparison of at least 20 positions, wherein the portion of the polynucleotide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases occurs in both sequences to yield the number of matched positions, dividing the number of matched positions by the total number of positions in the reference sequence (i.e., the window size) and multiplying the results by 100 to yield the percentage of sequence identity.

It will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

Therefore, in another embodiment of the invention, a mutagenesis approach, such as site-specific mutagenesis, is employed for the preparation of immunogenic variants and/or derivatives of the polypeptides described herein. By this approach, specific modifications in a polypeptide sequence can be made through mutagenesis of the underlying polynucleotides that encode them. These techniques provides a straightforward approach to prepare and test sequence variants, for example, incorporating one or more of the foregoing considerations, by introducing one or more nucleotide sequence changes into the polynucleotide.

Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Mutations may be employed in a selected polynucleotide sequence to improve, alter, decrease, modify, or otherwise change the properties of the polynucleotide itself, and/or alter the properties, activity, composition, stability, or primary sequence of the encoded polypeptide.

In certain embodiments of the present invention, the inventors contemplate the mutagenesis of the disclosed polynucleotide sequences to alter one or more properties of the encoded polypeptide, such as the immunogenicity of a polypeptide vaccine. The techniques of site-specific mutagenesis are well-known in the art, and are widely used to create variants of both polypeptides and polynucleotides. For example, site-specific mutagenesis is often used to alter a specific portion of a DNA molecule. In such embodiments, a primer comprising typically about 14 to about 25 nucleotides or so in length is employed, with about 5 to about 10 residues on both sides of the junction of the sequence being altered.

As will be appreciated by those of skill in the art, site-specific mutagenesis techniques have often employed a phage vector that exists in both a single stranded and double stranded form. Typical vectors useful in site-directed mutagenesis include vectors such as the M13 phage. These phage are readily commercially-available and their use is generally well-known to those skilled in the art. Double-stranded plasmids are also routinely employed in site directed mutagenesis that eliminates the step of transferring the gene of interest from a plasmid to a phage.

In general, site-directed mutagenesis in accordance herewith is performed by first obtaining a single-stranded vector or melting apart of two strands of a double-stranded vector that includes within its sequence a DNA sequence that encodes the desired peptide. An oligonucleotide primer bearing the desired mutated sequence is prepared, generally synthetically. This primer is then annealed with the single-stranded vector, and subjected to DNA polymerizing enzymes such as *E. coli* polymerase I Klenow fragment, in order to complete the synthesis of the mutation-bearing strand. Thus, a heteroduplex is formed wherein one strand encodes the original non-mutated sequence and the second strand bears the desired mutation. This heteroduplex vector is then used to transform appropriate cells, such as *E. coli* cells, and clones are selected which include recombinant vectors bearing the mutated sequence arrangement.

The preparation of sequence variants of the selected peptide-encoding DNA segments using site-directed mutagenesis provides a means of producing potentially useful species and is not meant to be limiting as there are other ways in which sequence variants of peptides and the DNA sequences encoding them may be obtained. For example, recombinant vectors encoding the desired peptide sequence may be treated with mutagenic agents, such as hydroxylamine, to obtain sequence variants. Specific details regarding these methods and protocols are found in the teachings of Maloy et al., 1994; Segal, 1976; Prokop and Bajpai, 1991; Kuby, 1994; and Maniatis et al., 1982, each incorporated herein by reference, for that purpose.

As used herein, the term "oligonucleotide directed mutagenesis procedure" refers to template-dependent processes and vector-mediated propagation which result in an increase in the concentration of a specific nucleic acid molecule relative to its initial concentration, or in an increase in the concentration of a detectable signal, such as amplification. As used herein, the term "oligonucleotide directed mutagenesis procedure" is intended to refer to a process that involves the template-dependent extension of a primer molecule. The term template dependent process refers to nucleic acid synthesis of an RNA or a DNA molecule wherein the sequence of the newly synthesized strand of nucleic acid is dictated by the well-known rules of complementary base pairing (see, for example, Watson, 1987). Typically, vector mediated methodologies involve the introduction of the nucleic acid fragment into a DNA or RNA vector, the clonal amplification of the vector, and the recovery of the amplified nucleic acid fragment. Examples of such methodologies are provided by U.S. Pat. No. 4,237,224, specifically incorporated herein by reference in its entirety.

In another approach for the production of polypeptide variants of the present invention, recursive sequence recombination, as described in U.S. Pat. No. 5,837,458, may be employed. In this approach, iterative cycles of recombination and screening or selection are performed to "evolve" individual polynucleotide variants of the invention having, for example, enhanced immunogenic activity.

In other embodiments of the present invention, the polynucleotide sequences provided herein can be advantageously used as probes or primers for nucleic acid hybridization. As such, it is contemplated that nucleic acid segments that comprise a sequence region of at least about 15 nucleotide long contiguous sequence that has the same sequence as, or is complementary to, a 15 nucleotide long contiguous sequence disclosed herein will find particular utility. Longer contiguous identical or complementary sequences, e.g., those of about 20, 30, 40, 50, 100, 200, 500, 1000 (including all intermediate lengths) and even up to full length sequences will also be of use in certain embodiments.

The ability of such nucleic acid probes to specifically hybridize to a sequence of interest will enable them to be of use in detecting the presence of complementary sequences in a given sample. However, other uses are also envisioned, such as the use of the sequence information for the preparation of mutant species primers, or primers for use in preparing other genetic constructions.

Polynucleotide molecules having sequence regions consisting of contiguous nucleotide stretches of 10-14, 15-20, 30, 50, or even of 100-200 nucleotides or so (including intermediate lengths as well), identical or complementary to a polynucleotide sequence disclosed herein, are particularly contemplated as hybridization probes for use in, e.g., Southern and Northern blotting. This would allow a gene product, or fragment thereof, to be analyzed, both in diverse cell types and also in various bacterial cells. The total size of fragment, as well as the size of the complementary stretch (es), will ultimately depend on the intended use or application of the particular nucleic acid segment. Smaller fragments will generally find use in hybridization embodiments, wherein the length of the contiguous complementary region may be varied, such as between about 15 and about 100 nucleotides, but larger contiguous complementarity stretches may be used, according to the length complementary sequences one wishes to detect.

The use of a hybridization probe of about 15-25 nucleotides in length allows the formation of a duplex molecule that is both stable and selective. Molecules having contiguous complementary sequences over stretches greater than 15 bases in length are generally preferred, though, in order to increase stability and selectivity of the hybrid, and thereby improve the quality and degree of specific hybrid molecules obtained. One will generally prefer to design nucleic acid molecules having gene-complementary stretches of 15 to 25 contiguous nucleotides, or even longer where desired.

Hybridization probes may be selected from any portion of any of the sequences disclosed herein. All that is required is to review the sequences set forth herein, or to any continuous portion of the sequences, from about 15-25 nucleotides in length up to and including the full length sequence, that one wishes to utilize as a probe or primer. The choice of probe and primer sequences may be governed by various factors. For example, one may wish to employ primers from towards the termini of the total sequence.

Small polynucleotide segments or fragments may be readily prepared by, for example, directly synthesizing the fragment by chemical means, as is commonly practiced using an automated oligonucleotide synthesizer. Also, fragments may be obtained by application of nucleic acid reproduction technology, such as the PCR™ technology of U.S. Pat. No. 4,683,202 (incorporated herein by reference), by introducing selected sequences into recombinant vectors for recombinant production, and by other recombinant DNA techniques generally known to those of skill in the art of molecular biology.

The nucleotide sequences of the invention may be used for their ability to selectively form duplex molecules with complementary stretches of the entire gene or gene fragments of interest. Depending on the application envisioned, one will typically desire to employ varying conditions of hybridization to achieve varying degrees of selectivity of probe towards target sequence. For applications requiring high selectivity, one will typically desire to employ relatively stringent conditions to form the hybrids, e.g., one will select relatively low salt and/or high temperature conditions, such as provided by a salt concentration of from about 0.02 M to about 0.15 M salt at temperatures of from about 50° C. to about 70° C. Such selective conditions tolerate little, if any, mismatch between the probe and the template or target strand, and would be particularly suitable for isolating related sequences.

Of course, for some applications, for example, where one desires to prepare mutants employing a mutant primer strand hybridized to an underlying template, less stringent (reduced stringency) hybridization conditions will typically be needed in order to allow formation of the heteroduplex. In these circumstances, one may desire to employ salt conditions such as those of from about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature. Thus, hybridization conditions can be readily manipulated, and thus will generally be a method of choice depending on the desired results.

According to another embodiment of the present invention, polynucleotide compositions comprising antisense oligonucleotides are provided. Antisense oligonucleotides have been demonstrated to be effective and targeted inhibitors of protein synthesis, and, consequently, provide a therapeutic approach by which a disease can be treated by inhibiting the synthesis of proteins that contribute to the disease. The efficacy of antisense oligonucleotides for inhibiting protein synthesis is well established. For example, the synthesis of polygalactauronase and the muscarine type 2 acetylcholine receptor are inhibited by antisense oligonucleotides directed to their respective mRNA sequences (U.S. Pat. No. 5,739,119 and U.S. Pat. No. 5,759,829). Further, examples of antisense inhibition have been demonstrated with the nuclear protein cyclin, the multiple drug resistance gene (MDG1), ICAM-1, E-selectin, STK-1, striatal $GABA_A$ receptor and human EGF (Jaskulski et al., Science. 1988 Jun. 10;240 (4858):1544-6; Vasanthakumar and Ahmed, Cancer Commun. 1989; 1(4):225-32; Peris et al., Brain Res Mol Brain Res. 1998 Jun. 15;57(2):310-20; U.S. Pat. No. 5,801,154; U.S. Pat. No. 5,789,573; U.S. Pat. No. 5,718,709 and U.S. Pat. No. 5,610,288). Antisense constructs have also been described that inhibit and can be used to treat a variety of abnormal cellular proliferations, e.g. cancer (U.S. Pat. No. 5,747,470; U.S. Pat. No. 5,591,317 and U.S. Pat. No. 5,783,683).

Therefore, in certain embodiments, the present invention provides oligonucleotide sequences that comprise all, or a portion of, any sequence that is capable of specifically binding to polynucleotide sequence described herein, or a complement thereof. In one embodiment, the antisense oligonucleotides comprise DNA or derivatives thereof. In another embodiment, the oligonucleotides comprise RNA or derivatives thereof. In a third embodiment, the oligonucleotides are modified DNAs comprising a phosphorothioated modified backbone. In a fourth embodiment, the oligonucleotide sequences comprise peptide nucleic acids or derivatives thereof. In each case, preferred compositions comprise a sequence region that is complementary, and more preferably substantially-complementary, and even more preferably, completely complementary to one or more portions of polynucleotides disclosed herein. Selection of antisense compositions specific for a given gene sequence is based upon analysis of the chosen target sequence and determination of secondary structure, $T_m$, binding energy, and relative stability. Antisense compositions may be selected based upon their relative inability to form dimers, hairpins, or other secondary structures that would reduce or prohibit specific binding to the target mRNA in a host cell. Highly preferred target regions of the mRNA, are those which are at or near the AUG translation initiation codon, and those sequences which are substantially complementary to 5' regions of the mRNA. These secondary structure analyses and target site selection considerations can be performed, for example, using v.4 of the OLIGO primer analysis software and/or the BLASTN 2.0.5 algorithm software (Altschul et al., Nucleic Acids Res. 1997, 25(17):3389-402).

The use of an antisense delivery method employing a short peptide vector, termed MPG (27 residues), is also contemplated. The MPG peptide contains a hydrophobic domain derived from the fusion sequence of HIV gp41 and a hydrophilic domain from the nuclear localization sequence of SV40 T-antigen (Morris et al., Nucleic Acids Res. 1997 Jul. 15;25(14):2730-6). It has been demonstrated that several molecules of the MPG peptide coat the antisense oligonucleotides and can be delivered into cultured mammalian cells in less than 1 hour with relatively high efficiency (90%). Further, the interaction with MPG strongly increases both the stability of the oligonucleotide to nuclease and the ability to cross the plasma membrane.

According to another embodiment of the invention, the polynucleotide compositions described herein are used in the design and preparation of ribozyme molecules for inhibiting expression of the tumor polypeptides and proteins of the present invention in tumor cells. Ribozymes are RNA-protein complexes that cleave nucleic acids in a site-specific fashion. Ribozymes have specific catalytic domains that possess endonuclease activity (Kim and Cech, Proc Natl Acad Sci USA. 1987 December;84(24):8788-92; Forster and Symons, Cell. 1987 Apr. 24;49(2):211-20). For example, a large number of ribozymes accelerate phosphoester transfer reactions with a high degree of specificity, often cleaving only one of several phosphoesters in an oligonucleotide substrate (Cech et al., Cell. 1981 December; 27(3 Pt 2):487-96; Michel and Westhof, J Mol. Biol. 1990 Dec. 5;216(3):585-610; Reinhold-Hurek and Shub, Nature. 1992 May 14;357(6374):173-6). This specificity has been attributed to the requirement that the substrate bind via specific base-pairing interactions to the internal guide sequence ("IGS") of the ribozyme prior to chemical reaction.

Six basic varieties of naturally-occurring enzymatic RNAs are known presently. Each can catalyze the hydrolysis of RNA phosphodiester bonds in trans (and thus can cleave other RNA molecules) under physiological conditions. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

The enzymatic nature of a ribozyme is advantageous over many technologies, such as antisense technology (where a nucleic acid molecule simply binds to a nucleic acid target to block its translation) since the concentration of ribozyme necessary to affect a therapeutic treatment is lower than that of an antisense oligonucleotide. This advantage reflects the ability of the ribozyme to act enzymatically. Thus, a single ribozyme molecule is able to cleave many molecules of target RNA. In addition, the ribozyme is a highly specific inhibitor, with the specificity of inhibition depending not only on the base pairing mechanism of binding to the target RNA, but also on the mechanism of target RNA cleavage. Single mismatches, or base-substitutions, near the site of cleavage can completely eliminate catalytic activity of a ribozyme. Similar mismatches in antisense molecules do not prevent their action (Woolf et al., Proc Natl Acad Sci USA. 1992 Aug. 15;89(16):7305-9). Thus, the specificity of action of a ribozyme is greater than that of an antisense oligonucleotide binding the same RNA site.

The enzymatic nucleic acid molecule may be formed in a hammerhead, hairpin, a hepatitis δ virus, group I intron or RNaseP RNA (in association with an RNA guide sequence) or *Neurospora* VS RNA motif. Examples of hammerhead motifs are described by Rossi et al. Nucleic Acids Res. 1992 Sep. 11;20(17):4559-65. Examples of hairpin motifs are described by Hampel et al. (Eur. Pat. Appl. Publ. No. EP 0360257), Hampel and Tritz, Biochemistry 1989 Jun. 13;28

(12):4929-33; Hampel et al., Nucleic Acids Res. 1990 Jan. 25;18(2):299-304 and U.S. Pat. No. 5,631,359. An example of the hepatitis δ virus motif is described by Perrotta and Been, Biochemistry. 1992 Dec. 1;31(47):11843-52; an example of the RNaseP motif is described by Guerrier-Takada et al., Cell. 1983 December;35(3 Pt 2):849-57; Neurospora VS RNA ribozyme motif is described by Collins (Saville and Collins, Cell. 1990 May 18;61(4):685-96; Saville and Collins, Proc Natl Acad Sci USA. 1991 Oct. 1;88(19):8826-30; Collins and Olive, Biochemistry. 1993 Mar. 23;32(11):2795-9); and an example of the Group I intron is described in (U.S. Pat. No. 4,987,071). All that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule. Thus the ribozyme constructs need not be limited to specific motifs mentioned herein.

Ribozymes may be designed as described in Int. Pat. Appl. Publ. No. WO 93/23569 and Int. Pat. Appl. Publ. No. WO 94/02595, each specifically incorporated herein by reference) and synthesized to be tested in vitro and in vivo, as described. Such ribozymes can also be optimized for delivery. While specific examples are provided, those in the art will recognize that equivalent RNA targets in other species can be utilized when necessary.

Ribozyme activity can be optimized by altering the length of the ribozyme binding arms, or chemically synthesizing ribozymes with modifications that prevent their degradation by serum ribonucleases (see e.g., Int. Pat. Appl. Publ. No. WO 92/07065; Int. Pat. Appl. Publ. No. WO 93/15187; Int. Pat. Appl. Publ. No. WO 91/03162; Eur. Pat. Appl. Publ. No. 92110298.4; U.S. Pat. No. 5,334,711; and Int. Pat. Appl. Publ. No. WO 94/13688, which describe various chemical modifications that can be made to the sugar moieties of enzymatic RNA molecules), modifications which enhance their efficacy in cells, and removal of stem II bases to shorten RNA synthesis times and reduce chemical requirements.

Sullivan et al., (Int. Pat. Appl. Publ. No. WO 94/02595) describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination may be locally delivered by direct inhalation, by direct injection or by use of a catheter, infusion pump or stint. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Int. Pat. Appl. Publ. No. WO 94/02595 and Int. Pat. Appl. Publ. No. WO 93/23569, each specifically incorporated herein by reference.

Another means of accumulating high concentrations of a ribozyme(s) within cells is to incorporate the ribozyme-encoding sequences into a DNA expression vector. Transcription of the ribozyme sequences are driven from a promoter for eukaryotic RNA polymerase I (pol I), RNA polymerase II (pol II), or RNA polymerase III (pol III. Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters may also be used, providing that the prokaryotic RNA polymerase enzyme is expressed in the appropriate cells. Ribozymes expressed from such promoters have been shown to function in mammalian cells. Such transcription units can be incorporated into a variety of vectors for introduction into mammalian cells, including but not restricted to, plasmid DNA vectors, viral DNA vectors (such as adenovirus or adeno-associated vectors), or viral RNA vectors (such as retroviral, semliki forest virus, sindbis virus vectors).

In another embodiment of the invention, peptide nucleic acids (PNAs) compositions are provided. PNA is a DNA mimic in which the nucleobases are attached to a pseudopeptide backbone (Good and Nielsen, Antisense Nucleic Acid Drug Dev. 1997 7(4) 431-37). PNA is able to be utilized in a number methods that traditionally have used RNA or DNA. Often PNA sequences perform better in techniques than the corresponding RNA or DNA sequences and have utilities that are not inherent to RNA or DNA. A review of PNA including methods of making, characteristics of, and methods of using, is provided by Corey (*Trends Biotechnol* 1997 June;15(6):224-9). As such, in certain embodiments, one may prepare PNA sequences that are complementary to one or more portions of the ACE mRNA sequence, and such PNA compositions may be used to regulate, alter, decrease, or reduce the translation of ACE-specific mRNA, and thereby alter the level of ACE activity in a host cell to which such PNA compositions have been administered.

PNAs have 2-aminoethyl-glycine linkages replacing the normal phosphodiester backbone of DNA (Nielsen et al., *Science* 1991 Dec. 6;254(5037):1497-500; Hanvey et al., Science. 1992 Nov. 27;258(5087):1481-5; Hyrup and Nielsen, Bioorg Med. Chem. 1996 January;4(1):5-23). This chemistry has three important consequences: firstly, in contrast to DNA or phosphorothioate oligonucleotides, PNAs are neutral molecules; secondly, PNAs are achiral, which avoids the need to develop a stereoselective synthesis; and thirdly, PNA synthesis uses standard Boc or Fmoc protocols for solid-phase peptide synthesis, although other methods, including a modified Merrifield method, have been used.

PNA monomers or ready-made oligomers are commercially available from PerSeptive Biosystems (Framingham, Mass.). PNA syntheses by either Boc or Fmoc protocols are straightforward using manual or automated protocols (Norton et al., Bioorg Med. Chem. 1995 April; 3(4):437-45). The manual protocol lends itself to the production of chemically modified PNAs or the simultaneous synthesis of families of closely related PNAs.

As with peptide synthesis, the success of a particular PNA synthesis will depend on the properties of the chosen sequence. For example, while in theory PNAs can incorporate any combination of nucleotide bases, the presence of adjacent purines can lead to deletions of one or more residues in the product. In expectation of this difficulty, it is suggested that, in producing PNAs with adjacent purines, one should repeat the coupling of residues likely to be added inefficiently. This should be followed by the purification of PNAs by reverse-phase high-pressure liquid chromatography, providing yields and purity of product similar to those observed during the synthesis of peptides.

Modifications of PNAs for a given application may be accomplished by coupling amino acids during solid-phase synthesis or by attaching compounds that contain a carboxylic acid group to the exposed N-terminal amine. Alternatively, PNAs can be modified after synthesis by coupling to an introduced lysine or cysteine. The ease with which PNAs can be modified facilitates optimization for better solubility or for specific functional requirements. Once synthesized, the identity of PNAs and their derivatives can be confirmed by mass spectrometry. Several studies have made and utilized modifications of PNAs (for example, Norton et al., Bioorg Med. Chem. 1995 April;3(4):437-45; Petersen et al., J Pept Sci. 1995 May-June;1(3):175-83; Orum et al., Biotechniques. 1995 September;19(3):472-80; Footer et al., Biochemistry. 1996 Aug. 20;35(33):10673-9; Griffith et al., Nucleic Acids Res. 1995 Aug. 11;23(15):3003-8; Pardridge et al., Proc Natl Acad Sci USA. 1995 Jun. 6;92(12):5592-6; Boffa et al., Proc Natl Acad Sci USA. 1995 Mar. 14;92(6): 1901-5; Gambacorti-Passerini et al., Blood. 1996 Aug. 15;88(4):1411-7; Armitage et al., Proc Natl Acad Sci USA. 1997 Nov. 11;94(23):12320-5; Seeger et al., Biotechniques. 1997 September;23(3):512-7). U.S. Pat. No. 5,700,922 discusses PNA-DNA-PNA chimeric molecules and their uses in diagnostics, modulating protein in organisms, and treatment of conditions susceptible to therapeutics.

Methods of characterizing the antisense binding properties of PNAs are discussed in Rose (Anal Chem. 1993 Dec. 15;65(24):3545-9) and Jensen et al. (Biochemistry. 1997 Apr. 22;36(16):5072-7). Rose uses capillary gel electrophoresis to determine binding of PNAs to their complementary oligonucleotide, measuring the relative binding kinetics and stoichiometry. Similar types of measurements were made by Jensen et al. using BIAcore™ technology.

Other applications of PNAs that have been described and will be apparent to the skilled artisan include use in DNA strand invasion, antisense inhibition, mutational analysis, enhancers of transcription, nucleic acid purification, isolation of transcriptionally active genes, blocking of transcription factor binding, genome cleavage, biosensors, in situ hybridization, and the like.

Polynucleotide Identification, Characterization and Expression

Polynucleotides compositions of the present invention may be identified, prepared and/or manipulated using any of a variety of well established techniques (see generally, Sambrook et al., *Molecular Cloning: A Laboratory Manual*, Cold Spring Harbor Laboratories, Cold Spring Harbor, N.Y., 1989, and other like references). For example, a polynucleotide may be identified, as described in more detail below, by screening a microarray of cDNAs for tumor-associated expression (i.e., expression that is at least two fold greater in a tumor than in normal tissue, as determined using a representative assay provided herein). Such screens may be performed, for example, using the microarray technology of Affymetrix, Inc. (Santa Clara, Calif.) according to the manufacturer's instructions (and essentially as described by Schena et al., *Proc. Natl. Acad. Sci. USA* 93:10614-10619, 1996 and Heller et al., *Proc. Natl. Acad. Sci. USA* 94:2150-2155, 1997). Alternatively, polynucleotides may be amplified from cDNA prepared from cells expressing the proteins described herein, such as tumor cells.

Many template dependent processes are available to amplify a target sequences of interest present in a sample. One of the best known amplification methods is the polymerase chain reaction (PCR™) which is described in detail in U.S. Pat. Nos. 4,683,195, 4,683,202 and 4,800,159, each of which is incorporated herein by reference in its entirety. Briefly, in PCR™, two primer sequences are prepared which are complementary to regions on opposite complementary strands of the target sequence. An excess of deoxynucleoside triphosphates is added to a reaction mixture along with a DNA polymerase (e.g., Taq polymerase). If the target sequence is present in a sample, the primers will bind to the target and the polymerase will cause the primers to be extended along the target sequence by adding on nucleotides. By raising and lowering the temperature of the reaction mixture, the extended primers will dissociate from the target to form reaction products, excess primers will bind to the target and to the reaction product and the process is repeated. Preferably reverse transcription and PCR™ amplification procedure may be performed in order to quantify the amount of mRNA amplified. Polymerase chain reaction methodologies are well known in the art.

Any of a number of other template dependent processes, many of which are variations of the PCR™ amplification technique, are readily known and available in the art. Illustratively, some such methods include the ligase chain reaction (referred to as LCR), described, for example, in Eur. Pat. Appl. Publ. No. 320,308 and U.S. Pat. No. 4,883,750; Qbeta Replicase, described in PCT Intl. Pat. Appl. Publ. No. PCT/US87/00880; Strand Displacement Amplification (SDA) and Repair Chain Reaction (RCR). Still other amplification methods are described in Great Britain Pat. Appl. No. 2 202 328, and in PCT Intl. Pat. Appl. Publ. No. PCT/US89/01025. Other nucleic acid amplification procedures include transcription-based amplification systems (TAS) (PCT Intl. Pat. Appl. Publ. No. WO 88/10315), including nucleic acid sequence based amplification (NASBA) and 3SR. Eur. Pat. Appl. Publ. No. 329,822 describes a nucleic acid amplification process involving cyclically synthesizing single-stranded RNA ("ssRNA"), ssDNA, and double-stranded DNA (dsDNA). PCT Intl. Pat. Appl. Publ. No. WO 89/06700 describes a nucleic acid sequence amplification scheme based on the hybridization of a promoter/primer sequence to a target single-stranded DNA ("ssDNA") followed by transcription of many RNA copies of the sequence. Other amplification methods such as "RACE" (Frohman, 1990), and "one-sided PCR" (Ohara, 1989) are also well-known to those of skill in the art.

An amplified portion of a polynucleotide of the present invention may be used to isolate a full length gene from a suitable library (e.g., a tumor cDNA library) using well known techniques. Within such techniques, a library (cDNA or genomic) is screened using one or more polynucleotide probes or primers suitable for amplification. Preferably, a library is size-selected to include larger molecules. Random primed libraries may also be preferred for identifying 5' and upstream regions of genes. Genomic libraries are preferred for obtaining introns and extending 5' sequences.

For hybridization techniques, a partial sequence may be labeled (e.g., by nick-translation or end-labeling with $^{32}$P) using well known techniques. A bacterial or bacteriophage library is then generally screened by hybridizing filters containing denatured bacterial colonies (or lawns containing phage plaques) with the labeled probe (see Sambrook et al., *Molecular Cloning: A Laboratory Manual*, Cold Spring Harbor Laboratories, Cold Spring Harbor, N.Y., 1989). Hybridizing colonies or plaques are selected and expanded, and the DNA is isolated for further analysis. cDNA clones may be analyzed to determine the amount of additional sequence by, for example, PCR using a primer from the partial sequence and a primer from the vector. Restriction maps and partial sequences may be generated to identify one or more overlapping clones. The complete sequence may then be determined using standard techniques, which may involve generating a series of deletion clones. The resulting overlapping sequences can then assembled into a single contiguous sequence. A full length cDNA molecule can be generated by ligating suitable fragments, using well known techniques.

Alternatively, amplification techniques, such as those described above, can be useful for obtaining a full length coding sequence from a partial cDNA sequence. One such amplification technique is inverse PCR (see Triglia et al., Nucl. Acids Res. 16:8186, 1988), which uses restriction enzymes to generate a fragment in the known region of the gene. The fragment is then circularized by intramolecular ligation and used as a template for PCR with divergent primers derived from the known region. Within an alternative approach, sequences adjacent to a partial sequence may be retrieved by amplification with a primer to a linker sequence and a primer specific to a known region. The amplified sequences are typically subjected to a second round of amplification with the same linker primer and a second primer specific to the known region. A variation on this procedure, which employs two primers that initiate extension in opposite directions from the known sequence, is described in WO 96/38591. Another such technique is known as "rapid amplification of cDNA ends" or RACE. This technique involves the use of an internal primer and an external primer, which hybridizes to a polyA region or vector sequence, to identify sequences that are 5' and 3' of a known sequence. Additional techniques include capture PCR (Lagerstrom et al., PCR Methods Applic. 1:111-19, 1991) and walking PCR (Parker et al., Nucl. Acids. Res. 19:3055-60, 1991). Other methods employing amplification may also be employed to obtain a full length cDNA sequence.

In certain instances, it is possible to obtain a full length cDNA sequence by analysis of sequences provided in an expressed sequence tag (EST) database, such as that available from GenBank. Searches for overlapping ESTs may generally be performed using well known programs (e.g., NCBI BLAST searches), and such ESTs may be used to generate a contiguous full length sequence. Full length DNA sequences may also be obtained by analysis of genomic fragments.

In other embodiments of the invention, polynucleotide sequences or fragments thereof which encode polypeptides of the invention, or fusion proteins or functional equivalents thereof, may be used in recombinant DNA molecules to direct expression of a polypeptide in appropriate host cells. Due to the inherent degeneracy of the genetic code, other DNA sequences that encode substantially the same or a functionally equivalent amino acid sequence may be produced and these sequences may be used to clone and express a given polypeptide.

As will be understood by those of skill in the art, it may be advantageous in some instances to produce polypeptide-encoding nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence.

Moreover, the polynucleotide sequences of the present invention can be engineered using methods generally known in the art in order to alter polypeptide encoding sequences for a variety of reasons, including but not limited to, alterations which modify the cloning, processing, and/or expression of the gene product. For example, DNA shuffling by random fragmentation and PCR reassembly of gene fragments and synthetic oligonucleotides may be used to engineer the nucleotide sequences. In addition, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences may be ligated to a heterologous sequence to encode a fusion protein. For example, to screen peptide libraries for inhibitors of polypeptide activity, it may be useful to encode a chimeric protein that can be recognized by a commercially available antibody. A fusion protein may also be engineered to contain a cleavage site located between the polypeptide-encoding sequence and the heterologous protein sequence, so that the polypeptide may be cleaved and purified away from the heterologous moiety.

Sequences encoding a desired polypeptide may be synthesized, in whole or in part, using chemical methods well known in the art (see Caruthers, M. H. et al. (1980) Nucl. Acids Res. Symp. Ser. 215-223, Horn, T. et al. (1980) Nucl. Acids Res. Symp. Ser. 225-232). Alternatively, the protein itself may be produced using chemical methods to synthesize the amino acid sequence of a polypeptide, or a portion thereof. For example, peptide synthesis can be performed using various solid-phase techniques (Roberge, J. Y. et al. (1995) Science 269:202-204) and automated synthesis may be achieved, for example, using the ABI 431A Peptide Synthesizer (Perkin Elmer, Palo Alto, Calif.).

A newly synthesized peptide may be substantially purified by preparative high performance liquid chromatography (e.g., Creighton, T. (1983) Proteins, Structures and Molecular Principles, WH Freeman and Co., New York, N.Y.) or other comparable techniques available in the art. The composition of the synthetic peptides may be confirmed by amino acid analysis or sequencing (e.g., the Edman degradation procedure). Additionally, the amino acid sequence of a polypeptide, or any part thereof, may be altered during direct synthesis and/or combined using chemical methods with sequences from other proteins, or any part thereof, to produce a variant polypeptide.

In order to express a desired polypeptide, the nucleotide sequences encoding the polypeptide, or functional equivalents, may be inserted into appropriate expression vector, i.e., a vector which contains the necessary elements for the transcription and translation of the inserted coding sequence. Methods which are well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described, for example, in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems may be utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems.

The "control elements" or "regulatory sequences" present in an expression vector are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like may be used. In mammalian cell systems, promoters from mammalian genes or from mammalian viruses are generally preferred. If it is necessary to generate a cell line that contains multiple copies of the sequence encoding a polypeptide, vectors based on SV40 or EBV may be advantageously used with an appropriate selectable marker.

In bacterial systems, any of a number of expression vectors may be selected depending upon the use intended for the expressed polypeptide. For example, when large quantities are needed, for example for the induction of antibodies, vectors which direct high level expression of fusion proteins that are readily purified may be used. Such vectors include, but are not limited to, the multifunctional E. coli cloning and expression vectors such as BLUESCRIPT (Stratagene), in which the sequence encoding the polypeptide of interest may be ligated into the vector in frame with sequences for the amino-terminal Met and the subsequent 7 residues of .beta.-galactosidase so that a hybrid protein is produced; pIN vectors (Van Heeke, G. and S. M. Schuster (1989) J. Biol. Chem. 264:5503-5509); and the like. pGEX Vectors (Promega, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast, Saccharomyces cerevisiae, a number of vectors containing constitutive or inducible promoters such as alpha factor, alcohol oxidase, and PGH may be used. For reviews, see Ausubel et al. (supra) and Grant et al. (1987) Methods Enzymol. 153:516-544.

In cases where plant expression vectors are used, the expression of sequences encoding polypeptides may be driven by any of a number of promoters. For example, viral promoters such as the 35S and 19S promoters of CaMV may be used alone or in combination with the omega leader sequence from TMV (Takamatsu, N. (1987) EMBO J. 6:307-311. Alternatively, plant promoters such as the small subunit of RUBISCO or heat shock promoters may be used (Coruzzi, G. et al. (1984) EMBO J. 3:1671-1680; Broglie, R. et al. (1984) Science 224:838-843; and Winter, J. et al. (1991) Results Probl. Cell Differ. 17:85-105). These constructs can be introduced into plant cells by direct DNA transformation or pathogen-mediated transfection. Such techniques are described in a number of generally available reviews (see, for example, Hobbs, S. or Murry, L. E. in McGraw Hill Yearbook of Science and Technology (1992) McGraw Hill, New York, N.Y.; pp. 191-196).

An insect system may also be used to express a polypeptide of interest. For example, in one such system, Autographa californica nuclear polyhedrosis virus (AcNPV) is used as a vector to express foreign genes in Spodoptera frugiperda cells or in Trichoplusia larvae. The sequences encoding the polypeptide may be cloned into a non-essential region of the virus, such as the polyhedrin gene, and placed under control of the polyhedrin promoter. Successful insertion of the polypeptide-encoding sequence will render the polyhedrin gene inactive and produce recombinant virus lacking coat protein. The recombinant viruses may then be used to infect, for example, S. frugiperda cells or Trichoplusia larvae in which the polypeptide of interest may be expressed (Engelhard, E. K. et al. (1994) Proc. Natl. Acad. Sci. 91 :3224-3227).

In mammalian host cells, a number of viral-based expression systems are generally available. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus which is capable of expressing the polypeptide in infected host cells (Logan, J. and Shenk, T. (1984) Proc. Nat. Acad. Sci. 81:3655-3659). In addition, transcription enhancers, such as the Rous sarcoma virus (RSV) enhancer, may be used to increase expression in mammalian host cells.

Specific initiation signals may also be used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) Results Probl. Cell Differ. 20:125-162).

In addition, a host cell strain may be chosen for its ability to modulate the expression of the inserted sequences or to process the expressed protein in the desired fashion. Such modifications of the polypeptide include, but are not limited to, acetylation, carboxylation. glycosylation, phosphorylation, lipidation, and acylation. Post-translational processing which cleaves a "prepro" form of the protein may also be used to facilitate correct insertion, folding and/or function. Different host cells such as CHO, COS, HeLa, MDCK, HEK293, and WI38, which have specific cellular machinery and characteristic mechanisms for such post-translational activities, may be chosen to ensure the correct modification and processing of the foreign protein.

For long-term, high-yield production of recombinant proteins, stable expression is generally preferred. For example, cell lines which stably express a polynucleotide of interest may be transformed using expression vectors which may contain viral origins of replication and/or endogenous expression elements and a selectable marker gene on the same or on a separate vector. Following the introduction of the vector, cells may be allowed to grow for 1-2 days in an enriched media before they are switched to selective media. The purpose of the selectable marker is to confer resistance to selection, and its presence allows growth and recovery of cells which successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler, M. et al. (1977) Cell 11:223-32) and adenine phosphoribosyltransferase (Lowy, I. et al. (1990) Cell 22:817-23) genes which can be employed in tk.sup.- or aprt.sup.- cells, respectively. Also, antimetabolite, antibiotic or herbicide resistance can be used as the basis for selection; for example, dhfr which confers resistance to methotrexate (Wigler, M. et al. (1980) Proc. Natl. Acad. Sci. 77:3567-70); npt, which confers resistance to the aminoglycosides, neomycin and G-418 (Colbere-Garapin, F. et al (1981) J. Mol. Biol. 150:1-14); and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine (Hartman, S. C. and R. C. Mulligan (1988) Proc. Nat. Acad. Sci. 85:8047-51). The use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) Methods Mol. Biol. 55:121-131).

Although the presence/absence of marker gene expression suggests that the gene of interest is also present, its presence and expression may need to be confirmed. For example, if the sequence encoding a polypeptide is inserted within a marker gene sequence, recombinant cells containing sequences can be identified by the absence of marker gene function. Alternatively, a marker gene can be placed in tandem with a polypeptide-encoding sequence under the control of a single promoter. Expression of the marker gene in response to induction or selection usually indicates expression of the tandem gene as well.

Alternatively, host cells that contain and express a desired polynucleotide sequence may be identified by a variety of procedures known to those of skill in the art. These procedures include, but are not limited to, DNA-DNA or DNA-RNA hybridizations and protein bioassay or immunoassay techniques which include, for example, membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide may be preferred for some applications, but a competitive binding assay may also be employed. These and other assays are described, among other places, in Hampton, R. et al. (1990; Serological Methods, a Laboratory Manual, APS Press, St Paul. Minn.) and Maddox, D. E. et al. (1983; J. Exp. Med. 158:1211-1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits. Suitable reporter molecules or labels, which may be used include radionuclides, enzymes, fluorescent, chemiluminescent, or chromogenic agents as well as substrates, cofactors, inhibitors, magnetic particles, and the like.

Host cells transformed with a polynucleotide sequence of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides of the invention may be designed to contain signal sequences which direct secretion of the encoded polypeptide through a prokaryotic or eukaryotic cell membrane. Other recombinant constructions may be used to join sequences encoding a polypeptide of interest to nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (Invitrogen. San Diego, Calif.) between the purification domain and the encoded polypeptide may be used to facilitate purification. One such expression vector provides for expression of a fusion protein containing a polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath, J. et al. (1992, Prot. Exp. Purif. 3:263-281) while the enterokinase cleavage site provides a means for purifying the desired polypeptide from the fusion protein. A discussion of vectors which contain fusion proteins is provided in Kroll, D. J. et al. (1993; DNA Cell Biol. 12:441-453).

In addition to recombinant production methods, polypeptides of the invention, and fragments thereof, may be produced by direct peptide synthesis using solid-phase techniques (Merrifield J. (1963) J. Am. Chem. Soc. 85:2149-2154). Protein synthesis may be performed using manual techniques or by automation. Automated synthesis may be achieved, for example, using Applied Biosystems 431A Peptide Synthesizer (Perkin Elmer). Alternatively, various fragments may be chemically synthesized separately and combined using chemical methods to produce the full length molecule.

Antibody Compositions, Fragments thereof and Other Binding Agents

According to another aspect, the present invention further provides binding agents, such as antibodies and antigen-binding fragments thereof, that exhibit immunological binding to a tumor polypeptide disclosed herein, or to a portion, variant or derivative thereof. An antibody, or antigen-binding fragment thereof, is said to "specifically bind," "immunogically bind," and/or is "immunologically reactive" to a polypeptide of the invention if it reacts at a detectable level (within, for example, an ELISA assay) with the polypeptide, and does not react detectably with unrelated polypeptides under similar conditions.

Immunological binding, as used in this context, generally refers to the non-covalent interactions of the type which occur between an immunoglobulin molecule and an antigen for which the immunoglobulin is specific. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and on geometric parameters that equally influence the rate in both directions. Thus, both the "on rate constant" ($K_{on}$) and the "off rate constant" ($K_{off}$) can be determined by calculation of the concentrations and the actual rates of association and dissociation. The ratio of $K_{off}/K_{on}$ enables cancellation of all parameters not related to affinity, and is thus equal to the dissociation constant $K_d$. See, generally, Davies et al. (1990) Annual Rev. Biochem. 59:439-473.

An "antigen-binding site," or "binding portion" of an antibody refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains are referred to as "hypervariable regions" which are interposed between more conserved flanking stretches known as "framework regions," or "FRs". Thus the term "FR" refers to amino acid sequences which are naturally found between and adjacent to hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs."

Binding agents may be further capable of differentiating between patients with and without a cancer, such as lung cancer, using the representative assays provided herein. For example, antibodies or other binding agents that bind to a tumor protein will preferably generate a signal indicating the presence of a cancer in at least about 20% of patients with the disease, more preferably at least about 30% of patients. Alternatively, or in addition, the antibody will generate a negative signal indicating the absence of the disease in at least about 90% of individuals without the cancer. To determine whether a binding agent satisfies this requirement, biological samples (e.g., blood, sera, sputum, urine and/or tumor biopsies) from patients with and without a cancer (as determined using standard clinical tests) may be assayed as described herein for the presence of polypeptides that bind to the binding agent. Preferably, a statistically significant number of samples with and without the disease will be assayed. Each binding agent should satisfy the above criteria; however, those of ordinary skill in the art will recognize that binding agents may be used in combination to improve sensitivity.

Any agent that satisfies the above requirements may be a binding agent. For example, a binding agent may be a ribosome, with or without a peptide component, an RNA molecule or a polypeptide. In a preferred embodiment, a binding agent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, preferably according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

Monoclonal antibodies specific for an antigenic polypeptide of interest may be prepared, for example, using the technique of Kohler and Milstein, *Eur. J. Immunol.* 6:511-519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, preferably one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. A preferred selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

A number of therapeutically useful molecules are known in the art which comprise antigen-binding sites that are capable of exhibiting immunological binding properties of an antibody molecule. The proteolytic enzyme papain preferentially cleaves IgG molecules to yield several fragments, two of which (the "F(ab)" fragments) each comprise a covalent heterodimer that includes an intact antigen-binding site. The enzyme pepsin is able to cleave IgG molecules to provide several fragments, including the "F(ab')$_2$" fragment which comprises both antigen-binding sites. An "Fv" fragment can be produced by preferential proteolytic cleavage of an IgM, and on rare occasions IgG or IgA immunoglobulin molecule. Fv fragments are, however, more commonly derived using recombinant techniques known in the art. The Fv fragment includes a non-covalent $V_H::V_L$ heterodimer including an antigen-binding site which retains much of the antigen recognition and binding capabilities of the native antibody molecule. Inbar et al. (1972) Proc. Nat. Acad. Sci. USA 69:2659-2662; Hochman et al. (1976) Biochem 15:2706-2710; and Ehrlich et al. (1980) Biochem 19:4091-4096.

A single chain Fv ("sFv") polypeptide is a covalently linked $V_H::V_L$ heterodimer which is expressed from a gene fusion including $V_H$- and $V_L$-encoding genes linked by a peptide-encoding linker. Huston et al. (1988) Proc. Nat. Acad. Sci. USA 85(16):5879-5883. A number of methods have been described to discern chemical structures for converting the naturally aggregated—but chemically separated—light and heavy polypeptide chains from an antibody V region into an sFv molecule which will fold into a three dimensional structure substantially similar to the structure of an antigen-binding site. See, e.g., U.S. Pat. Nos. 5,091,513 and 5,132,405, to Huston et al.; and U.S. Pat. No. 4,946,778, to Ladner et al.

Each of the above-described molecules includes a heavy chain and a light chain CDR set, respectively interposed between a heavy chain and a light chain FR set which provide support to the CDRS and define the spatial relationship of the CDRs relative to each other. As used herein, the term "CDR set" refers to the three hypervariable regions of a heavy or light chain V region. Proceeding from the N-terminus of a heavy or light chain, these regions are denoted as "CDR1," "CDR2," and "CDR3" respectively. An antigen-binding site, therefore, includes six CDRs, comprising the CDR set from each of a heavy and a light chain V region. A polypeptide comprising a single CDR, (e.g., a CDR1, CDR2 or CDR3) is referred to herein as a "molecular recognition unit." Crystallographic analysis of a number of antigen-antibody complexes has demonstrated that the amino acid residues of CDRs form extensive contact with bound antigen, wherein the most extensive antigen contact is with the heavy chain CDR3. Thus, the molecular recognition units are primarily responsible for the specificity of an antigen-binding site.

As used herein, the term "FR set" refers to the four flanking amino acid sequences which frame the CDRs of a CDR set of a heavy or light chain V region. Some FR residues may contact bound antigen; however, FRs are primarily responsible for folding the V region into the antigen-binding site, particularly the FR residues directly adjacent to the CDRS. Within FRs, certain amino residues and certain structural features are very highly conserved. In this regard, all V region sequences contain an internal disulfide loop of around 90 amino acid residues. When the V regions fold into a binding-site, the CDRs are displayed as projecting loop motifs which form an antigen-binding surface. It is generally recognized that there are conserved structural regions of FRs which influence the folded shape of the CDR loops into certain "canonical" structures—regardless of the precise CDR amino acid sequence. Further, certain FR residues are known to participate in non-covalent interdomain contacts which stabilize the interaction of the antibody heavy and light chains.

A number of "humanized" antibody molecules comprising an antigen-binding site derived from a non-human immunoglobulin have been described, including chimeric antibodies having rodent V regions and their associated CDRs fused to human constant domains (Winter et al. (1991) Nature 349:293-299; Lobuglio et al. (1989) Proc. Nat. Acad. Sci. USA 86:4220-4224; Shaw et al. (1987) J. Immunol. 138:4534-4538; and Brown et al. (1987) Cancer Res. 47:3577-3583), rodent CDRs grafted into a human supporting FR prior to fusion with an appropriate human antibody constant domain (Riechmann et al. (1988) Nature 332:323-327; Verhoeyen et al. (1988) Science 239:1534-1536; and Jones et al. (1986) Nature 321:522-525), and rodent CDRs supported by recombinantly veneered rodent FRs (European Patent Publication No. 519,596, published Dec. 23, 1992). These "humanized" molecules are designed to minimize unwanted immunological response toward rodent antihuman antibody molecules which limits the duration and effectiveness of therapeutic applications of those moieties in human recipients.

As used herein, the terms "veneered FRs" and "recombinantly veneered FRs" refer to the selective replacement of FR residues from, e.g., a rodent heavy or light chain V region, with human FR residues in order to provide a xenogeneic molecule comprising an antigen-binding site which retains substantially all of the native FR polypeptide folding structure. Veneering techniques are based on the understanding that the ligand binding characteristics of an antigen-binding site are determined primarily by the structure and relative disposition of the heavy and light chain CDR sets within the antigen-binding surface. Davies et al. (1990) Ann. Rev. Biochem. 59:439-473. Thus, antigen binding specificity can be preserved in a humanized antibody only wherein the CDR structures, their interaction with each other, and their interaction with the rest of the V region domains are carefully maintained. By using veneering techniques, exterior (e.g., solvent-accessible) FR residues which are readily encountered by the immune system are selectively replaced with human residues to provide a hybrid molecule that comprises either a weakly immunogenic, or substantially non-immunogenic veneered surface.

The process of veneering makes use of the available sequence data for human antibody variable domains compiled by Kabat et al., in Sequences of Proteins of Immunological Interest, 4th ed., (U.S. Dept. of Health and Human Services, U.S. Government Printing Office, 1987), updates to the Kabat database, and other accessible U.S. and foreign databases (both nucleic acid and protein). Solvent accessibilities of V region amino acids can be deduced from the known three-dimensional structure for human and murine antibody fragments. There are two general steps in veneering a murine antigen-binding site. Initially, the FRs of the variable domains of an antibody molecule of interest are compared with corresponding FR sequences of human variable domains obtained from the above-identified sources. The most homologous human V regions are then compared residue by residue to corresponding murine amino acids. The residues in the murine FR which differ from the human counterpart are replaced by the residues present in the human moiety using recombinant techniques well known in the art. Residue switching is only carried out with moieties which are at least partially exposed (solvent accessible), and care is exercised in the replacement of amino acid residues which may have a significant effect on the tertiary structure of V region domains, such as proline, glycine and charged amino acids.

In this manner, the resultant "veneered" murine antigen-binding sites are thus designed to retain the murine CDR residues, the residues substantially adjacent to the CDRs, the residues identified as buried or mostly buried (solvent inaccessible), the residues believed to participate in non-covalent (e.g., electrostatic and hydrophobic) contacts between heavy and light chain domains, and the residues from conserved structural regions of the FRs which are believed to influence the "canonical" tertiary structures of the CDR loops. These design criteria are then used to prepare recombinant nucleotide sequences which combine the CDRs of both the heavy and light chain of a murine antigen-binding site into human-appearing FRs that can be used to transfect mammalian cells for the expression of recombinant human antibodies which exhibit the antigen specificity of the murine antibody molecule.

In another embodiment of the invention, monoclonal antibodies of the present invention may be coupled to one or more therapeutic agents. Suitable agents in this regard include radionuclides, differentiation inducers, drugs, toxins, and derivatives thereof. Preferred radionuclides include $^{90}Y$, $^{123}I$, $^{125}I$, $^{131}I$, $^{186}Re$, $^{188}Re$, $^{211}At$, and $^{212}Bi$. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, *Pseudomonas* exotoxin, *Shigella* toxin, and pokeweed antiviral protein.

A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be effected, for example, through amino groups, carboxyl groups, sulfhydryl groups or oxidized carbohydrate residues. There are numerous references describing such methodology, e.g., U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways. For example, more than one agent may be coupled directly to an antibody molecule, or linkers that provide multiple sites for attachment can be used. Alternatively, a carrier can be used.

A carrier may bear the agents in a variety of ways, including covalent bonding either directly or via a linker group. Suitable carriers include proteins such as albumins (e.g., U.S. Pat. No. 4,507,234, to Kato et al.), peptides and polysaccharides such as aminodextran (e.g., U.S. Pat. No. 4,699,784, to Shih et al.). A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, or metal oxide, radionuclide. For example, U.S. Pat. No. 4,673,562, to Davison et al. discloses representative chelating compounds and their synthesis.

T Cell Compositions

The present invention, in another aspect, provides T cells specific for a tumor polypeptide disclosed herein, or for a variant or derivative thereof. Such cells may generally be prepared in vitro or ex vivo, using standard procedures. For example, T cells may be isolated from bone marrow, peripheral blood, or a fraction of bone marrow or peripheral blood of a patient, using a commercially available cell separation system, such as the Isolex™ System, available from Nexell Therapeutics, Inc. (Irvine, Calif.; see also U.S. Pat. No. 5,240,856; U.S. Pat. No. 5,215,926; WO 89/06280; WO 91/16116 and WO 92/07243). Alternatively, T cells may be derived from related or unrelated humans, non-human mammals, cell lines or cultures.

T cells may be stimulated with a polypeptide, polynucleotide encoding a polypeptide and/or an antigen presenting cell (APC) that expresses such a polypeptide. Such stimulation is performed under conditions and for a time sufficient to permit the generation of T cells that are specific for the polypeptide of interest. Preferably, a tumor polypeptide or polynucleotide of the invention is present within a delivery vehicle, such as a microsphere, to facilitate the generation of specific T cells.

T cells are considered to be specific for a polypeptide of the present invention if the T cells specifically proliferate, secrete cytokines or kill target cells coated with the polypeptide or expressing a gene encoding the polypeptide. T cell specificity may be evaluated using any of a variety of standard techniques. For example, within a chromium release assay or proliferation assay, a stimulation index of more than two fold increase in lysis and/or proliferation, compared to negative controls, indicates T cell specificity.

Such assays may be performed, for example, as described in Chen et al., *Cancer Res.* 54:1065-1070, 1994. Alternatively, detection of the proliferation of T cells may be accomplished by a variety of known techniques. For example, T cell proliferation can be detected by measuring an increased rate of DNA synthesis (e.g., by pulse-labeling cultures of T cells with tritiated thymidine and measuring the amount of tritiated thymidine incorporated into DNA). Contact with a tumor polypeptide (100 ng/ml-100 µg/ml, preferably 200 ng/ml-25 µg/ml) for 3-7 days will typically result in at least a two fold increase in proliferation of the T cells. Contact as described above for 2-3 hours should result in activation of the T cells, as measured using standard cytokine assays in which a two fold increase in the level of cytokine release (e.g., TNF or IFN-γ) is indicative of T cell activation (see Coligan et al., Current Protocols in Immunology, vol. 1, Wiley Interscience (Greene 1998)). T cells that have been activated in response to a tumor polypeptide, polynucleotide or polypeptide-expressing APC may be $CD4^+$ and/or $CD8^+$. Tumor polypeptide-specific T cells may be expanded using standard techniques. Within preferred embodiments, the T cells are derived from a patient, a related donor or an unrelated donor, and are administered to the patient following stimulation and expansion.

For therapeutic purposes, $CD4^+$ or $CD8^+$ T cells that proliferate in response to a tumor polypeptide, polynucleotide or APC can be expanded in number either in vitro or in vivo. Proliferation of such T cells in vitro may be accomplished in a variety of ways. For example, the T cells can be re-exposed to a tumor polypeptide, or a short peptide corresponding to an immunogenic portion of such a polypeptide, with or without the addition of T cell growth factors, such as interleukin-2, and/or stimulator cells that synthesize a tumor polypeptide. Alternatively, one or more T cells that proliferate in the presence of the tumor polypeptide can be expanded in number by cloning. Methods for cloning cells are well known in the art, and include limiting dilution.

T Cell Receptor Compositions

The T cell receptor (TCR) consists of 2 different, highly variable polypeptide chains, termed the T-cell receptor α and β chains, that are linked by a disulfide bond (Janeway, Travers, Walport. *Immunobiology*. Fourth Ed., 148-159. Elsevier Science Ltd/Garland Publishing. 1999). The α/β heterodimer complexes with the invariant CD3 chains at the cell membrane. This complex recognizes specific antigenic peptides bound to MHC molecules. The enormous diversity of TCR specificities is generated much like immunoglobulin diversity, through somatic gene rearrangement. The β chain genes contain over 50 variable (V), 2 diversity (D), over 10 joining (J) segments, and 2 constant region segments (C). The α chain genes contain over 70 V segments, and over 60 J segments but no D segments, as well as one C segment. During T cell development in the thymus, the D to J gene rearrangement of the β chain occurs, followed by the V gene segment rearrangement to the DJ. This functional $VDJ_\beta$ exon is transcribed and spliced to join to a $C_\beta$. For the α chain, a $V_\alpha$ gene segment rearranges to a $J_\alpha$ gene segment to create the functional exon that is then transcribed and spliced to the $C_\alpha$. Diversity is further increased during the recombination process by the random addition of P and N-nucleotides between the V, D, and J segments of the β chain and between the V and J segments in the α chain (Janeway, Travers, Walport. *Immunobiology*. Fourth Ed., 98 and 150. Elsevier Science Ltd/Garland Publishing. 1999).

The present invention, in another aspect, provides TCRs specific for a polypeptide disclosed herein, or for a variant or derivative thereof. In accordance with the present invention, polynucleotide and amino acid sequences are provided for the V-J or V-D-J junctional regions or parts thereof for the alpha and beta chains of the T-cell receptor which recognize tumor polypeptides described herein. In general, this aspect of the invention relates to T-cell receptors which recognize or bind tumor polypeptides presented in the context of MHC. In a preferred embodiment the tumor antigens recognized by the T-cell receptors comprise a polypeptide of the present invention. For example, cDNA encoding a TCR specific for a _tumor peptide can be isolated from T cells specific for a tumor polypeptide using standard molecular biological and recombinant DNA techniques.

This invention further includes the T-cell receptors or analogs thereof having substantially the same function or activity as the T-cell receptors of this invention which recognize or bind tumor polypeptides. Such receptors include, but are not limited to, a fragment of the receptor, or a substitution, addition or deletion mutant of a T-cell receptor provided herein. This invention also encompasses polypeptides or peptides that are substantially homologous to the T-cell receptors provided herein or that retain substantially the same activity. The term "analog" includes any protein or polypeptide having an amino acid residue sequence substantially identical to the T-cell receptors provided herein in which one or more residues, preferably no more than 5 residues, more preferably no more than 25 residues have been conservatively substituted with a functionally similar residue and which displays the functional aspects of the T-cell receptor as described herein.

The present invention further provides for suitable mammalian host cells, for example, non-specific T cells, that are transfected with a polynucleotide encoding TCRs specific for a polypeptide described herein, thereby rendering the host cell specific for the polypeptide. The α and β chains of the TCR may be contained on separate expression vectors or alternatively, on a single expression vector that also contains an internal ribosome entry site (IRES) for cap-independent translation of the gene downstream of the IRES. Said host cells expressing TCRs specific for the polypeptide may be used, for example, for adoptive immunotherapy of lung cancer as discussed further below.

In further aspects of the present invention, cloned TCRs specific for a polypeptide recited herein may be used in a kit for the diagnosis of lung cancer. For example, the nucleic acid sequence or portions thereof, of tumor-specific TCRs can be used as probes or primers for the detection of expression of the rearranged genes encoding the specific TCR in a biological sample. Therefore, the present invention further provides for an assay for detecting messenger RNA or DNA encoding the TCR specific for a polypeptide.

Pharmaceutical Compositions

In additional embodiments, the present invention concerns formulation of one or more of the polynucleotide, polypeptide, T-cell and/or antibody compositions disclosed herein in pharmaceutically-acceptable carriers for administration to a cell or an animal, either alone, or in combination with one or more other modalities of therapy.

It will be understood that, if desired, a composition as disclosed herein may be administered in combination with other agents as well, such as, e.g., other proteins or polypeptides or various pharmaceutically-active agents. In fact, there is virtually no limit to other components that may also be included, given that the additional agents do not cause a significant adverse effect upon contact with the target cells or host tissues. The compositions may thus be delivered along with various other agents as required in the particular instance. Such compositions may be purified from host cells or other biological sources, or alternatively may be chemically synthesized as described herein. Likewise, such compositions may further comprise substituted or derivatized RNA or DNA compositions.

Therefore, in another aspect of the present invention, pharmaceutical compositions are provided comprising one or more of the polynucleotide, polypeptide, antibody, and/or T-cell compositions described herein in combination with a physiologically acceptable carrier. In certain preferred embodiments, the pharmaceutical compositions of the invention comprise immunogenic polynucleotide and/or polypeptide compositions of the invention for use in prophylactic and theraputic vaccine applications. Vaccine preparation is generally described in, for example, M. F. Powell and M. J. Newman, eds., "Vaccine Design (the subunit and adjuvant approach)," Plenum Press (NY, 1995). Generally, such compositions will comprise one or more polynucleotide and/or polypeptide compositions of the present invention in combination with one or more immunostimulants.

It will be apparent that any of the pharmaceutical compositions described herein can contain pharmaceutically acceptable salts of the polynucleotides and polypeptides of the invention. Such salts can be prepared, for example, from pharmaceutically acceptable non-toxic bases, including organic bases (e.g., salts of primary, secondary and tertiary amines and basic amino acids) and inorganic bases (e.g., sodium, potassium, lithium, ammonium, calcium and magnesium salts).

In another embodiment, illustrative immunogenic compositions, e.g., vaccine compositions, of the present invention comprise DNA encoding one or more of the polypeptides as described above, such that the polypeptide is generated in situ. As noted above, the polynucleotide may be administered within any of a variety of delivery systems known to those of ordinary skill in the art. Indeed, numerous gene delivery techniques are well known in the art, such as those described by Rolland, *Crit. Rev. Therap. Drug Carrier Systems* 15:143-198, 1998, and references cited therein. Appropriate polynucleotide expression systems will, of course, contain the necessary regulatory DNA regulatory sequences for expression in a patient (such as a suitable promoter and terminating signal). Alternatively, bacterial delivery systems may involve the administration of a *bacterium* (such as *Bacillus-Calmette-Guerrin*) that expresses an immunogenic portion of the polypeptide on its cell surface or secretes such an epitope.

Therefore, in certain embodiments, polynucleotides encoding immunogenic polypeptides described herein are introduced into suitable mammalian host cells for expression using any of a number of known viral-based systems. In one illustrative embodiment, retroviruses provide a convenient and effective platform for gene delivery systems. A selected nucleotide sequence encoding a polypeptide of the present invention can be inserted into a vector and packaged in retroviral particles using techniques known in the art. The recombinant virus can then be isolated and delivered to a subject. A number of illustrative retroviral systems have been described (e.g., U.S. Pat. No. 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3:102-109.

In addition, a number of illustrative adenovirus-based systems have also been described. Unlike retroviruses which integrate into the host genome, adenoviruses persist extrachromosomally thus minimizing the risks associated with insertional mutagenesis (Haj-Ahmad and Graham (1986) J. Virol. 57:267-274; Bett et al. (1993) J. Virol. 67:5911-5921; Mittereder et al. (1994) Human Gene Therapy 5:717-729; Seth et al. (1994) J. Virol. 68:933-940; Barr et al. (1994) Gene Therapy 1:51-58; Berkner, K. L. (1988) BioTechniques 6:616-629; and Rich et al. (1993) Human Gene Therapy 4:461-476).

Various adeno-associated virus (AAV) vector systems have also been developed for polynucleotide delivery. AAV vectors can be readily constructed using techniques well known in the art. See, e.g., U.S. Pat. Nos. 5,173,414 and 5,139,941; International Publication Nos. WO 92/01070 and WO 93/03769; Lebkowski et al. (1988) Molec. Cell. Biol. 8:3988-3996; Vincent et al. (1990) Vaccines 90 (Cold Spring Harbor Laboratory Press); Carter, B. J. (1992) Current Opinion in Biotechnology 3:533-539; Muzyczka, N. (1992) Current Topics in Microbiol. and Immunol. 158:97-129; Kotin, R. M. (1994) Human Gene Therapy 5:793-801; Shelling and Smith (1994) Gene Therapy 1:165-169; and Zhou et al. (1994) J. Exp. Med. 179:1867-1875.

Additional viral vectors useful for delivering the polynucleotides encoding polypeptides of the present invention by gene transfer include those derived from the pox family of viruses, such as vaccinia virus and avian poxvirus. By way of example, vaccinia virus recombinants expressing the novel molecules can be constructed as follows. The DNA encoding a polypeptide is first inserted into an appropriate vector so that it is adjacent to a vaccinia promoter and flanking vaccinia DNA sequences, such as the sequence encoding thymidine kinase (TK). This vector is then used to transfect cells which are simultaneously infected with vaccinia. Homologous recombination serves to insert the vaccinia promoter plus the gene encoding the polypeptide of interest into the viral genome. The resulting TK.sup.(−) recombinant can be selected by culturing the cells in the presence of 5-bromodeoxyuridine and picking viral plaques resistant thereto.

A vaccinia-based infection/transfection system can be conveniently used to provide for inducible, transient expression or coexpression of one or more polypeptides described herein in host cells of an organism. In this particular system, cells are first infected in vitro with a vaccinia virus recombinant that encodes the bacteriophage T7 RNA polymerase. This polymerase displays exquisite specificity in that it only transcribes templates bearing T7 promoters. Following infection, cells are transfected with the polynucleotide or polynucleotides of interest, driven by a T7 promoter. The polymerase expressed in the cytoplasm from the vaccinia virus recombinant transcribes the transfected DNA into RNA which is then translated into polypeptide by the host translational machinery. The method provides for high level, transient, cytoplasmic production of large quantities of RNA and its translation products. See, e.g., Elroy-Stein and Moss, Proc. Natl. Acad. Sci. USA (1990) 87:6743-6747; Fuerst et al. Proc. Natl. Acad. Sci. USA (1986) 83:8122-8126.

Alternatively, avipoxviruses, such as the fowlpox and canarypox viruses, can also be used to deliver the coding sequences of interest. Recombinant avipox viruses, expressing immunogens from mammalian pathogens, are known to confer protective immunity when administered to non-avian species. The use of an Avipox vector is particularly desirable in human and other mammalian species since members of the Avipox genus can only productively replicate in susceptible avian species and therefore are not infective in mammalian cells. Methods for producing recombinant Avipoxviruses are known in the art and employ genetic recombination, as described above with respect to the production of vaccinia viruses. See, e.g., WO 91/12882; WO 89/03429; and WO 92/03545.

Any of a number of alphavirus vectors can also be used for delivery of polynucleotide compositions of the present invention, such as those vectors described in U.S. Pat. Nos. 5,843,723; 6,015,686; 6,008,035 and 6,015,694. Certain vectors based on Venezuelan Equine Encephalitis (VEE) can also be used, illustrative examples of which can be found in U.S. Pat. Nos. 5,505,947 and 5,643,576.

Moreover, molecular conjugate vectors, such as the adenovirus chimeric vectors described in Michael et al. J. Biol. Chem. (1993) 268:6866-6869 and Wagner et al. Proc. Natl. Acad. Sci. USA (1992) 89:6099-6103, can also be used for gene delivery under the invention.

Additional illustrative information on these and other known viral-based delivery systems can be found, for example, in Fisher-Hoch et al., *Proc. Natl. Acad. Sci. USA* 86:317-321, 1989; Flexner et al., *Ann. N.Y. Acad. Sci.* 569:86-103, 1989; Flexner et al., *Vaccine* 8:17-21, 1990; U.S. Pat. Nos. 4,603,112, 4,769,330, and 5,017,487; WO 89/01973; U.S. Pat. No. 4,777,127; GB 2,200,651; EP 0,345,242; WO 91/02805; Berkner, *Biotechniques* 6:616-627, 1988; Rosenfeld et al., *Science* 252:431-434, 1991; Kolls et al., *Proc. Natl. Acad. Sci. USA* 91:215-219, 1994; Kass-Eisler et al., *Proc. Natl. Acad. Sci. USA* 90:11498-11502, 1993; Guzman et al., *Circulation* 88:2838-2848, 1993; and Guzman et al., *Cir. Res.* 73:1202-1207, 1993.

In certain embodiments, a polynucleotide may be integrated into the genome of a target cell. This integration may be in the specific location and orientation via homologous recombination (gene replacement) or it may be integrated in a random, non-specific location (gene augmentation). In yet further embodiments, the polynucleotide may be stably maintained in the cell as a separate, episomal segment of DNA. Such polynucleotide segments or "episomes" encode sequences sufficient to permit maintenance and replication independent of or in synchronization with the host cell cycle. The manner in which the expression construct is delivered to a cell and where in the cell the polynucleotide remains is dependent on the type of expression construct employed.

In another embodiment of the invention, a polynucleotide is administered/delivered as "naked" DNA, for example as described in Ulmer et al., *Science* 259:1745-1749, 1993 and reviewed by Cohen, *Science* 259:1691-1692, 1993. The uptake of naked DNA may be increased by coating the DNA onto biodegradable beads, which are efficiently transported into the cells.

In still another embodiment, a composition of the present invention can be delivered via a particle bombardment approach, many of which have been described. In one illustrative example, gas-driven particle acceleration can be achieved with devices such as those manufactured by Powderject Pharmaceuticals PLC (Oxford, UK) and Powderject Vaccines Inc. (Madison, Wis.), some examples of which are described in U.S. Pat. Nos. 5,846,796; 6,010,478; 5,865,796; 5,584,807; and EP Patent No. 0500 799. This approach offers a needle-free delivery approach wherein a dry powder formulation of microscopic particles, such as polynucleotide or polypeptide particles, are accelerated to high speed within a helium gas jet generated by a hand held device, propelling the particles into a target tissue of interest.

In a related embodiment, other devices and methods that may be useful for gas-driven needle-less injection of compositions of the present invention include those provided by Bioject, Inc. (Portland, Oreg.), some examples of which are described in U.S. Pat. Nos. 4,790,824; 5,064,413; 5,312,335; 5,383,851; 5,399,163; 5,520,639 and 5,993,412.

According to another embodiment, the pharmaceutical compositions described herein will comprise one or more immunostimulants in addition to the immunogenic polynucleotide, polypeptide, antibody, T-cell and/or APC compositions of this invention. An immunostimulant refers to essentially any substance that enhances or potentiates an immune response (antibody and/or cell-mediated) to an exogenous antigen. One preferred type of immunostimulant comprises an adjuvant. Many adjuvants contain a substance designed to protect the antigen from rapid catabolism, such as aluminum hydroxide or mineral oil, and a stimulator of immune responses, such as lipid A, *Bortadella pertussis* or *Mycobacterium tuberculosis* derived proteins. Certain adjuvants are commercially available as, for example, Freund's Incomplete Adjuvant and Complete Adjuvant (Difco Laboratories, Detroit, Mich.); Merck Adjuvant 65 (Merck and Company, Inc., Rahway, N.J.); AS-2 (SmithKline Beecham, Philadelphia, Pa.); aluminum salts such as aluminum hydroxide gel (alum) or aluminum phosphate; salts of calcium, iron or zinc; an insoluble suspension of acylated tyrosine; acylated sugars; cationically or anionically derivatized polysaccharides; polyphosphazenes; biodegradable microspheres; monophosphoryl lipid A, QS21, aminoalkyl glucosaminide 4-phosphates, and quil A. Cytokines, such as GM-CSF, interleukin-2, -7, -12, and other like growth factors, may also be used as adjuvants.

Within certain embodiments of the invention, the adjuvant composition is preferably one that induces an immune response predominantly of the Th1 type. High levels of Th1-type cytokines (e.g., IFN-γ, TNFα, IL-2 and IL-12) tend to favor the induction of cell mediated immune responses to an administered antigen. In contrast, high levels of Th2-type cytokines (e.g., IL-4, IL-5, IL-6 and IL-10) tend to favor the induction of humoral immune responses. Following application of a vaccine as provided herein, a patient will support an immune response that includes Th1- and Th2-type responses. Within a preferred embodiment, in which a response is predominantly Th1-type, the level of Th1-type cytokines will increase to a greater extent than the level of Th2-type cytokines. The levels of these cytokines may be readily assessed using standard assays. For a review of the families of cytokines, see Mosmann and Coffman, *Ann. Rev. Immunol.* 7:145-173, 1989.

Certain preferred adjuvants for eliciting a predominantly Th1-type response include, for example, a combination of monophosphoryl lipid A, preferably 3-de-O-acylated monophosphoryl lipid A, together with an aluminum salt. MPL® adjuvants are available from Corixa Corporation (Seattle, Wash.; see, for example, U.S. Pat. Nos. 4,436,727; 4,877,611; 4,866,034 and 4,912,094). CpG-containing oligonucleotides (in which the CpG dinucleotide is unmethylated) also induce a predominantly Th1 response. Such oligonucleotides are well known and are described, for example, in WO 96/02555, WO 99/33488 and U.S. Pat. Nos. 6,008,200 and 5,856,462. Immunostimulatory DNA sequences are also described, for example, by Sato et al., *Science* 273:352, 1996. Another preferred adjuvant comprises a saponin, such as Quil A, or derivatives thereof, including QS21 and QS7 (Aquila Biopharmaceuticals Inc., Framingham, Mass.); Escin; Digitonin; or *Gypsophila* or *Chenopodium quinoa* saponins. Other preferred formulations include more than one saponin in the adjuvant combinations of the present invention, for example combinations of at least two of the following group comprising QS21, QS7, Quil A, β-escin, or digitonin.

Alternatively the saponin formulations may be combined with vaccine vehicles composed of chitosan or other polycationic polymers, polylactide and polylactide-co-glycolide particles, poly-N-acetyl glucosamine-based polymer matrix, particles composed of polysaccharides or chemically modified polysaccharides, liposomes and lipid-based particles, particles composed of glycerol monoesters, etc. The saponins may also be formulated in the presence of cholesterol to form particulate structures such as liposomes or ISCOMs. Furthermore, the saponins may be formulated together with a polyoxyethylene ether or ester, in either a non-particulate solution or suspension, or in a particulate structure such as a paucilamelar liposome or ISCOM. The saponins may also be formulated with excipients such as Carbopol® to increase viscosity, or may be formulated in a dry powder form with a powder excipient such as lactose.

In one preferred embodiment, the adjuvant system includes the combination of a monophosphoryl lipid A and a saponin derivative, such as the combination of QS21 and 3D-MPL® adjuvant, as described in WO 94/00153, or a less reactogenic composition where the QS21 is quenched with cholesterol, as described in WO 96/33739. Other preferred formulations comprise an oil-in-water emulsion and tocopherol. Another particularly preferred adjuvant formulation employing QS21, 3D-MPL® adjuvant and tocopherol in an oil-in-water emulsion is described in WO 95/17210.

Another enhanced adjuvant system involves the combination of a CpG-containing oligonucleotide and a saponin derivative particularly the combination of CpG and QS21 is disclosed in WO 00/09159. Preferably the formulation additionally comprises an oil in water emulsion and tocopherol.

Additional illustrative adjuvants for use in the pharmaceutical compositions of the invention include Montanide ISA 720 (Seppic, France), SAF (Chiron, Calif., United States), ISCOMS (CSL), MF-59 (Chiron), the SBAS series of adjuvants (e.g., SBAS-2 or SBAS-4, available from SmithKline Beecham, Rixensart, Belgium), Detox (Enhanzyn®) (Corixa, Hamilton, Mont.), RC-529 (Corixa, Hamilton, Mont.) and other aminoalkyl glucosaminide 4-phosphates (AGPs), such as those described in pending U.S. patent application Ser. Nos. 08/853,826 and 09/074,720, the disclosures of which are incorporated herein by reference in their entireties, and polyoxyethylene ether adjuvants such as those described in WO 99/52549A1.

Other preferred adjuvants include adjuvant molecules of the general formula

$$HO(CH_2CH_2O)_n\text{-}A\text{-}R,\quad (I):$$

wherein, n is 1-50, A is a bond or —C(O)—, R is $C_{1\text{-}50}$ alkyl or Phenyl $C_{1\text{-}50}$ alkyl.

One embodiment of the present invention consists of a vaccine formulation comprising a polyoxyethylene ether of general formula (I), wherein n is between 1 and 50, preferably 4-24, most preferably 9; the R component is $C_{1\text{-}50}$, preferably $C_4$-$C_{20}$ alkyl and most preferably $C_{1\text{-}2}$ alkyl, and A is a bond. The concentration of the polyoxyethylene ethers should be in the range 0.1-20%, preferably from 0.1-10%, and most preferably in the range 0.1-1%. Preferred polyoxyethylene ethers are selected from the following group: polyoxyethylene-9-lauryl ether, polyoxyethylene-9-steoryl ether, polyoxyethylene-8-steoryl ether, polyoxyethylene-4-lauryl ether, polyoxyethylene-35-lauryl ether, and polyoxyethylene-23-lauryl ether. Polyoxyethylene ethers such as polyoxyethylene lauryl ether are described in the Merck index (12$^{th}$ edition: entry 7717). These adjuvant molecules are described in WO 99/52549.

The polyoxyethylene ether according to the general formula (I) above may, if desired, be combined with another adjuvant. For example, a preferred adjuvant combination is preferably with CpG as described in the pending UK patent application GB 9820956.2.

According to another embodiment of this invention, an immunogenic composition described herein is delivered to a host via antigen presenting cells (APCs), such as dendritic cells, macrophages, B cells, monocytes and other cells that may be engineered to be efficient APCs. Such cells may, but need not, be genetically modified to increase the capacity for presenting the antigen, to improve activation and/or maintenance of the T cell response, to have anti-tumor effects per se and/or to be immunologically compatible with the receiver (i.e., matched HLA haplotype). APCs may generally be isolated from any of a variety of biological fluids and organs, including tumor and peritumoral tissues, and may be autologous, allogeneic, syngeneic or xenogeneic cells.

Certain preferred embodiments of the present invention use dendritic cells or progenitors thereof as antigen-presenting cells. Dendritic cells are highly potent APCs (Banchereau and Steinman, Nature 392:245-251, 1998) and have been shown to be effective as a physiological adjuvant for eliciting prophylactic or therapeutic antitumor immunity (see Timmerman and Levy, Ann. Rev. Med. 50:507-529, 1999). In general, dendritic cells may be identified based on their typical shape (stellate in situ, with marked cytoplasmic processes (dendrites) visible in vitro), their ability to take up, process and present antigens with high efficiency and their ability to activate naïve T cell responses. Dendritic cells may, of course, be engineered to express specific cell-surface receptors or ligands that are not commonly found on dendritic cells in vivo or ex vivo, and such modified dendritic cells are contemplated by the present invention. As an alternative to dendritic cells, secreted vesicles antigen-loaded dendritic cells (called exosomes) may be used within a vaccine (see Zitvogel et al., Nature Med. 4:594-600, 1998).

Dendritic cells and progenitors may be obtained from peripheral blood, bone marrow, tumor-infiltrating cells, peritumoral tissues-infiltrating cells, lymph nodes, spleen, skin, umbilical cord blood or any other suitable tissue or fluid. For example, dendritic cells may be differentiated ex vivo by adding a combination of cytokines such as GM-CSF, IL-4, IL-13 and/or TNFα to cultures of monocytes harvested from peripheral blood. Alternatively, CD34 positive cells harvested from peripheral blood, umbilical cord blood or bone marrow may be differentiated into dendritic cells by adding to the culture medium combinations of GM-CSF, IL-3, TNFα, CD40 ligand, LPS, flt3 ligand and/or other compound(s) that induce differentiation, maturation and proliferation of dendritic cells.

Dendritic cells are conveniently categorized as "immature" and "mature" cells, which allows a simple way to discriminate between two well characterized phenotypes. However, this nomenclature should not be construed to exclude all possible intermediate stages of differentiation. Immature dendritic cells are characterized as APC with a high capacity for antigen uptake and processing, which correlates with the high expression of Fcγ receptor and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1BB).

APCs may generally be transfected with a polynucleotide of the invention (or portion or other variant thereof such that the encoded polypeptide, or an immunogenic portion thereof, is expressed on the cell surface. Such transfection may take place ex vivo, and a pharmaceutical composition comprising such transfected cells may then be used for therapeutic purposes, as described herein. Alternatively, a gene delivery vehicle that targets a dendritic or other antigen presenting cell may be administered to a patient, resulting in transfection that occurs in vivo. In vivo and ex vivo transfection of dendritic cells, for example, may generally be performed using any methods known in the art, such as those described in WO 97/24447, or the gene gun approach described by Mahvi et al., *Immunology and cell Biology* 75:456-460, 1997. Antigen loading of dendritic cells may be achieved by incubating dendritic cells or progenitor cells with the tumor polypeptide, DNA (naked or within a plasmid vector) or RNA; or with antigen-expressing recombinant *bacterium* or viruses (e.g., vaccinia, fowlpox, adenovirus or lentivirus vectors). Prior to loading, the polypeptide may be covalently conjugated to an immunological partner that provides T cell help (e.g., a carrier molecule). Alternatively, a dendritic cell may be pulsed with a non-conjugated immunological partner, separately or in the presence of the polypeptide.

While any suitable carrier known to those of ordinary skill in the art may be employed in the pharmaceutical compositions of this invention, the type of carrier will typically vary depending on the mode of administration. Compositions of the present invention may be formulated for any appropriate manner of administration, including for example, topical, oral, nasal, mucosal, intravenous, intracranial, intraperitoneal, subcutaneous and intramuscular administration.

Carriers for use within such pharmaceutical compositions are biocompatible, and may also be biodegradable. In certain embodiments, the formulation preferably provides a relatively constant level of active component release. In other embodiments, however, a more rapid rate of release immediately upon administration may be desired. The formulation of such compositions is well within the level of ordinary skill in the art using known techniques. Illustrative carriers useful in this regard include microparticles of poly(lactide-co-glycolide), polyacrylate, latex, starch, cellulose, dextran and the like. Other illustrative delayed-release carriers include supramolecular biovectors, which comprise a non-liquid hydrophilic core (e.g., a cross-linked polysaccharide or oligosaccharide) and, optionally, an external layer comprising an amphiphilic compound, such as a phospholipid (see e.g., U.S. Pat. No. 5,151,254 and PCT applications WO 94/20078, WO/94/23701 and WO 96/06638). The amount of active compound contained within a sustained release formulation depends upon the site of implantation, the rate and expected duration of release and the nature of the condition to be treated or prevented.

In another illustrative embodiment, biodegradable microspheres (e.g., polylactate polyglycolate) are employed as carriers for the compositions of this invention. Suitable biodegradable microspheres are disclosed, for example, in U.S. Pat. Nos. 4,897,268; 5,075,109; 5,928,647; 5,811,128; 5,820,883; 5,853,763; 5,814,344, 5,407,609 and 5,942,252. Modified hepatitis B core protein carrier systems. such as described in WO/99 40934, and references cited therein, will also be useful for many applications. Another illustrative carrier/delivery system employs a carrier comprising particulate-protein complexes, such as those described in U.S. Pat. No. 5,928,647, which are capable of inducing a class I-restricted cytotoxic T lymphocyte responses in a host.

The pharmaceutical compositions of the invention will often further comprise one or more buffers (e.g., neutral buffered saline or phosphate buffered saline), carbohydrates (e.g., glucose, mannose, sucrose or dextrans), mannitol, proteins, polypeptides or amino acids such as glycine, antioxidants, bacteriostats, chelating agents such as EDTA or glutathione, adjuvants (e.g., aluminum hydroxide), solutes that render the formulation isotonic, hypotonic or weakly hypertonic with the blood of a recipient, suspending agents, thickening agents and/or preservatives. Alternatively, compositions of the present invention may be formulated as a lyophilizate.

The pharmaceutical compositions described herein may be presented in unit-dose or multi-dose containers, such as sealed ampoules or vials. Such containers are typically sealed in such a way to preserve the sterility and stability of the formulation until use. In general, formulations may be stored as suspensions, solutions or emulsions in oily or aqueous vehicles. Alternatively, a pharmaceutical composition may be stored in a freeze-dried condition requiring only the addition of a sterile liquid carrier immediately prior to use.

The development of suitable dosing and treatment regimens for using the particular compositions described herein in a variety of treatment regimens, including e.g., oral, parenteral, intravenous, intranasal, and intramuscular administration and formulation, is well known in the art, some of which are briefly discussed below for general purposes of illustration.

In certain applications, the pharmaceutical compositions disclosed herein may be delivered via oral administration to an animal. As such, these compositions may be formulated with an inert diluent or with an assimilable edible carrier, or they may be enclosed in hard- or soft-shell gelatin capsule, or they may be compressed into tablets, or they may be incorporated directly with the food of the diet.

The active compounds may even be incorporated with excipients and used in the form of ingestible tablets, buccal tables, troches, capsules, elixirs, suspensions, syrups, wafers, and the like (see, for example, Mathiowitz et al., Nature 1997 Mar. 27; 386(6623):410-4; Hwang et al., Crit Rev Ther Drug Carrier Syst 1998; 15(3):243-84; U.S. Pat. No. 5,641,515; U.S. Pat. No. 5,580,579 and U.S. Pat. No. 5,792,451). Tablets, troches, pills, capsules and the like may also contain any of a variety of additional components, for example, a binder, such as gum tragacanth, acacia, cornstarch, or gelatin; excipients, such as dicalcium phosphate; a disintegrating agent, such as corn starch, potato starch, alginic acid and the like; a lubricant, such as magnesium stearate; and a sweetening agent, such as sucrose, lactose or saccharin may be added or a flavoring agent, such as peppermint, oil of wintergreen, or cherry flavoring. When the dosage unit form is a capsule, it may contain, in addition to materials of the above type, a liquid carrier. Various other materials may be present as coatings or to otherwise modify the physical form of the dosage unit. For instance, tablets, pills, or capsules may be coated with shellac, sugar, or both. Of course, any material used in preparing any dosage unit form should be pharmaceutically pure and substantially non-toxic in the amounts employed. In addition, the active compounds may be incorporated into sustained-release preparation and formulations.

Typically, these formulations will contain at least about 0.1% of the active compound or more, although the percentage of the active ingredient(s) may, of course, be varied and may conveniently be between about 1 or 2% and about 60% or 70% or more of the weight or volume of the total formulation. Naturally, the amount of active compound(s) in each therapeutically useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

For oral administration the compositions of the present invention may alternatively be incorporated with one or more excipients in the form of a mouthwash, dentifrice, buccal tablet, oral spray, or sublingual orally-administered formulation. Alternatively, the active ingredient may be incorporated into an oral solution such as one containing sodium borate, glycerin and potassium bicarbonate, or dispersed in a dentifrice, or added in a therapeutically-effective amount to a composition that may include water, binders, abrasives, flavoring agents, foaming agents, and humectants. Alternatively the compositions may be fashioned into a tablet or solution form that may be placed under the tongue or otherwise dissolved in the mouth.

In certain circumstances it will be desirable to deliver the pharmaceutical compositions disclosed herein parenterally, intravenously, intramuscularly, or even intraperitoneally. Such approaches are well known to the skilled artisan, some of which are further described, for example, in U.S. Pat. No. 5,543,158; U.S. Pat. No. 5,641,515 and U.S. Pat. No. 5,399,363. In certain embodiments, solutions of the active compounds as free base or pharmacologically acceptable salts may be prepared in water suitably mixed with a surfactant, such as hydroxypropylcellulose. Dispersions may also be prepared in glycerol, liquid polyethylene glycols, and mixtures thereof and in oils. Under ordinary conditions of storage and use, these preparations generally will contain a preservative to prevent the growth of microorganisms.

Illustrative pharmaceutical forms suitable for injectable use include sterile aqueous solutions or dispersions and sterile powders for the extemporaneous preparation of sterile injectable solutions or dispersions (for example, see U.S. Pat. No. 5,466,468). In all cases the form must be sterile and must be fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and/or by the use of surfactants. The prevention of the action of microorganisms can be facilitated by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

In one embodiment, for parenteral administration in an aqueous solution, the solution should be suitably buffered if necessary and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). Some variation in dosage will necessarily occur depending on the condition of the subject being treated. Moreover, for human administration, preparations will of course preferably meet sterility, pyrogenicity, and the general safety and purity standards as required by FDA Office of Biologics standards.

In another embodiment of the invention, the compositions disclosed herein may be formulated in a neutral or salt form. Illustrative pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective.

The carriers can further comprise any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically-acceptable" refers to molecular entities and compositions that do not produce an allergic or similar untoward reaction when administered to a human.

In certain embodiments, the pharmaceutical compositions may be delivered by intranasal sprays, inhalation, and/or other aerosol delivery vehicles. Methods for delivering genes, nucleic acids, and peptide compositions directly to the lungs via nasal aerosol sprays has been described, e.g., in U.S. Pat. No. 5,756,353 and U.S. Pat. No. 5,804,212. Likewise, the delivery of drugs using intranasal microparticle resins (Takenaga et al., J Controlled Release 1998 Mar. 2;52(1-2):81-7) and lysophosphatidyl-glycerol compounds (U.S. Pat. No. 5,725,871) are also well-known in the pharmaceutical arts. Likewise, illustrative transmucosal drug delivery in the form of a polytetrafluoroetheylene support matrix is described in U.S. Pat. No. 5,780,045.

In certain embodiments, liposomes, nanocapsules, microparticles, lipid particles, vesicles, and the like, are used for the introduction of the compositions of the present invention into suitable host cells/organisms. In particular, the compositions of the present invention may be formulated for delivery either encapsulated in a lipid particle, a liposome, a vesicle, a nanosphere, or a nanoparticle or the like. Alternatively, compositions of the present invention can be bound, either covalently or non-covalently, to the surface of such carrier vehicles.

The formation and use of liposome and liposome-like preparations as potential drug carriers is generally known to those of skill in the art (see for example, Lasic, Trends Biotechnol 1998 July; 16(7):307-21; Takakura, Nippon Rinsho 1998 March;56(3):691-5; Chandran et al., Indian J Exp Biol. 1997 August;35(8):801-9; Margalit, Crit Rev Ther Drug Carrier Syst. 1995;12(2-3):233-61; U.S. Pat. No. 5,567,434; U.S. Pat. No. 5,552,157; U.S. Pat. No. 5,565,213; U.S. Pat. No. 5,738,868 and U.S. Pat. No. 5,795,587, each specifically incorporated herein by reference in its entirety).

Liposomes have been used successfully with a number of cell types that are normally difficult to transfect by other procedures, including T cell suspensions, primary hepatocyte cultures and PC 12 cells (Renneisen et al., J Biol. Chem. 1990 Sep. 25;265(27):16337-42; Muller et al., DNA Cell Biol. 1990 April;9(3):221-9). In addition, liposomes are free of the DNA length constraints that are typical of viral-based delivery systems. Liposomes have been used effectively to introduce genes, various drugs, radiotherapeutic agents, enzymes, viruses, transcription factors, allosteric effectors and the like, into a variety of cultured cell lines and animals. Furthermore, he use of liposomes does not appear to be associated with autoimmune responses or unacceptable toxicity after systemic delivery.

In certain embodiments, liposomes are formed from phospholipids that are dispersed in an aqueous medium and spontaneously form multilamellar concentric bilayer vesicles (also termed multilamellar vesicles (MLVs).

Alternatively, in other embodiments, the invention provides for pharmaceutically-acceptable nanocapsule formulations of the compositions of the present invention. Nanocapsules can generally entrap compounds in a stable and reproducible way (see, for example, Quintanar-Guerrero et al., Drug Dev Ind Pharm. 1998 December;24(12):1113-28). To avoid side effects due to intracellular polymeric overloading, such ultrafine particles (sized around 0.1 μm) may be designed using polymers able to be degraded in vivo. Such particles can be made as described, for example, by Couvreur et al., Crit Rev Ther Drug Carrier Syst. 1988;5(1):1-20; zur Muhlen et al., Eur J Pharm Biopharm. 1998 March;45(2):149-55; Zambaux et al. J Controlled Release. 1998 Jan. 2;50(1-3):31-40; and U.S. Pat. No. 5,145,684.

Cancer Therapeutic Methods

Immunologic approaches to cancer therapy are based on the recognition that cancer cells can often evade the body's defenses against aberrant or foreign cells and molecules, and that these defenses might be therapeutically stimulated to regain the lost ground, e.g. pgs. 623-648 in Klein, Immunology (Wiley-Interscience, New York, 1982). Numerous recent observations that various immune effectors can directly or indirectly inhibit growth of tumors has led to renewed interest in this approach to cancer therapy, e.g. Jager, et al., Oncology 2001;60(1):1-7; Renner, et al., Ann Hematol 2000 December;79(12):651-9.

Four-basic cell types whose function has been associated with antitumor cell immunity and the elimination of tumor cells from the body are: i) B-lymphocytes which secrete immunoglobulins into the blood plasma for identifying and labeling the nonself invader cells; ii) monocytes which secrete the complement proteins that are responsible for lysing and processing the immunoglobulin-coated target invader cells; iii) natural killer lymphocytes having two mechanisms for the destruction of tumor cells, antibody-dependent cellular cytotoxicity and natural killing; and iv) T-lymphocytes possessing antigen-specific receptors and having the capacity to recognize a tumor cell carrying complementary marker molecules (Schreiber, H., 1989, in Fundamental Immunology (ed). W. E. Paul, pp. 923-955).

Cancer immunotherapy generally focuses on inducing humoral immune responses, cellular immune responses, or both. Moreover, it is well established that induction of $CD4^+$ T helper cells is necessary in order to secondarily induce either antibodies or cytotoxic $CD8^+$ T cells. Polypeptide antigens that are selective or ideally specific for cancer cells, particularly lung cancer cells, offer a powerful approach for inducing immune responses against lung cancer, and are an important aspect of the present invention.

Therefore, in further aspects of the present invention, the pharmaceutical compositions described herein may be used for the treatment of cancer, particularly for the immunotherapy of lung cancer. Within such methods, the pharmaceutical compositions described herein are administered to a patient, typically a warm-blooded animal, preferably a human. A patient may or may not be afflicted with cancer. Accordingly, the above pharmaceutical compositions may be used to prevent the development of a cancer or to treat a patient afflicted with a cancer. Pharmaceutical compositions and vaccines may be administered either prior to or following surgical removal of primary tumors and/or treatment such as administration of radiotherapy or conventional chemotherapeutic drugs. As discussed above, administration of the pharmaceutical compositions may be by any suitable method, including administration by intravenous, intraperitoneal, intramuscular, subcutaneous, intranasal, intradermal, anal, vaginal, topical and oral routes.

Within certain embodiments, immunotherapy may be active immunotherapy, in which treatment relies on the in vivo stimulation of the endogenous host immune system to react against tumors with the administration of immune response-modifying agents (such as polypeptides and polynucleotides as provided herein).

Within other embodiments, immunotherapy may be passive immunotherapy, in which treatment involves the delivery of agents with established tumor-immune reactivity (such as effector cells or antibodies) that can directly or indirectly mediate antitumor effects and does not necessarily depend on an intact host immune system. Examples of effector cells include T cells as discussed above, T lymphocytes (such as $CD8^+$ cytotoxic T lymphocytes and $CD4^+$ T-helper tumor-infiltrating lymphocytes), killer cells (such as Natural Killer cells and lymphokine-activated killer cells), B cells and antigen-presenting cells (such as dendritic cells and macrophages) expressing a polypeptide provided herein. T cell receptors and antibody receptors specific for the polypeptides recited herein may be cloned, expressed and transferred into other vectors or effector cells for adoptive immunotherapy. The polypeptides provided herein may also be used to generate antibodies or anti-idiotypic antibodies (as described above and in U.S. Pat. No. 4,918,164) for passive immunotherapy.

Monoclonal antibodies may be labeled with any of a variety of labels for desired selective usages in detection, diagnostic assays or therapeutic applications (as described in U.S. Pat. Nos. 6,090,365; 6,015,542; 5,843,398; 5,595,721; and 4,708,930, hereby incorporated by reference in their entirety as if each was incorporated individually). In each case, the binding of the labelled monoclonal antibody to the determinant site of the antigen will signal detection or delivery of a particular therapeutic agent to the antigenic determinant on the non-normal cell. A further object of this invention is to provide the specific monoclonal antibody suitably labelled for achieving such desired selective usages thereof.

Effector cells may generally be obtained in sufficient quantities for adoptive immunotherapy by growth in vitro, as described herein. Culture conditions for expanding single antigen-specific effector cells to several billion in number with retention of antigen recognition in vivo are well known in the art. Such in vitro culture conditions typically use intermittent stimulation with antigen, often in the presence of cytokines (such as IL-2) and non-dividing feeder cells. As noted above, immunoreactive polypeptides as provided herein may be used to rapidly expand antigen-specific T cell cultures in order to generate a sufficient number of cells for immunotherapy. In particular, antigen-presenting cells, such as dendritic, macrophage, monocyte, fibroblast and/or B cells, may be pulsed with immunoreactive polypeptides or transfected with one or more polynucleotides using standard techniques well known in the art. For example, antigen-presenting cells can be transfected with a polynucleotide having a promoter appropriate for increasing expression in a recombinant virus or other expression system. Cultured effector cells for use in therapy must be able to grow and distribute widely, and to survive long term in vivo. Studies have shown that cultured effector cells can be induced to grow in vivo and to survive long term in substantial numbers by repeated stimulation with antigen supplemented with IL-2 (see, for example, Cheever et al., *Immunological Reviews* 157:177, 1997).

Alternatively, a vector expressing a polypeptide recited herein may be introduced into antigen presenting cells taken from a patient and clonally propagated ex vivo for transplant back into the same patient. Transfected cells may be reintroduced into the patient using any means known in the art, preferably in sterile form by intravenous, intracavitary, intraperitoneal or intratumor administration.

Routes and frequency of administration of the therapeutic compositions described herein, as well as dosage, will vary from individual to individual, and may be readily established using standard techniques. In general, the pharmaceutical compositions and vaccines may be administered by injection (e.g., intracutaneous, intramuscular, intravenous or subcutaneous), intranasally (e.g., by aspiration) or orally. Preferably, between 1 and 10 doses may be administered over a 52 week period. Preferably, 6 doses are administered, at intervals of 1 month, and booster vaccinations may be given periodically thereafter. Alternate protocols may be appropriate for individual patients. A suitable dose is an amount of a compound that, when administered as described above, is capable of promoting an anti-tumor immune response, and is at least 10-50% above the basal (i.e., untreated) level. Such response can be monitored by measuring the anti-tumor antibodies in a patient or by vaccine-dependent generation of cytolytic effector cells capable of killing the patient's tumor cells in vitro. Such vaccines should also be capable of causing an immune response that leads to an improved clinical outcome (e.g., more frequent remissions, complete or partial or longer disease-free survival) in vaccinated patients as compared to non-vaccinated patients. In general, for pharmaceutical compositions and vaccines comprising one or more polypeptides, the amount of each polypeptide present in a dose ranges from about 25 µg to 5 mg per kg of host. Suitable dose sizes will vary with the size of the patient, but will typically range from about 0.1 mL to about 5 mL.

In general, an appropriate dosage and treatment regimen provides the active compound(s) in an amount sufficient to provide therapeutic and/or prophylactic benefit. Such a response can be monitored by establishing an improved clinical outcome (e.g., more frequent remissions, complete or partial, or longer disease-free survival) in treated patients as compared to non-treated patients. Increases in preexisting immune responses to a tumor protein generally correlate with an improved clinical outcome. Such immune responses may generally be evaluated using standard proliferation, cytotoxicity or cytokine assays, which may be performed using samples obtained from a patient before and after treatment.

Cancer Detection and Diagnostic Compositions, Methods and Kits

In general, a cancer may be detected in a patient based on the presence of one or more lung tumor proteins and/or polynucleotides encoding such proteins in a biological sample (for example, blood, sera, sputum urine and/or tumor biopsies) obtained from the patient. In other words, such proteins may be used as markers to indicate the presence or absence of a cancer such as lung cancer. In addition, such proteins may be useful for the detection of other cancers. The binding agents provided herein generally permit detection of the level of antigen that binds to the agent in the biological sample.

Polynucleotide primers and probes may be used to detect the level of mRNA encoding a tumor protein, which is also indicative of the presence or absence of a cancer. In general, a tumor sequence should be present at a level that is at least two-fold, preferably three-fold, and more preferably five-fold or higher in tumor tissue than in normal tissue of the same type from which the tumor arose. Expression levels of a particular tumor sequence in tissue types different from that in which the tumor arose are irrelevant in certain diagnostic embodiments since the presence of tumor cells can be confirmed by observation of predetermined differential expression levels, e.g., 2-fold, 5-fold, etc, in tumor tissue to expression levels in normal tissue of the same type.

Other differential expression patterns can be utilized advantageously for diagnostic purposes. For example, in one aspect of the invention, overexpression of a tumor sequence in tumor tissue and normal tissue of the same type, but not in other normal tissue types, e.g. PBMCs, can be exploited diagnostically. In this case, the presence of metastatic tumor cells, for example in a sample taken from the circulation or some other tissue site different from that in which the tumor arose, can be identified and/or confirmed by detecting expression of the tumor sequence in the sample, for example using RT-PCR analysis. In many instances, it will be desired to enrich for tumor cells in the sample of interest, e.g., PBMCs, using cell capture or other like techniques.

There are a variety of assay formats known to those of ordinary skill in the art for using a binding agent to detect polypeptide markers in a sample. See, e.g., Harlow and Lane, *Antibodies: A Laboratory Manual*, Cold Spring Harbor Laboratory, 1988. In general, the presence or absence of a cancer in a patient may be determined by (a) contacting a biological sample obtained from a patient with a binding agent; (b) detecting in the sample a level of polypeptide that binds to the binding agent; and (c) comparing the level of polypeptide with a predetermined cut-off value.

In a preferred embodiment, the assay involves the use of binding agent immobilized on a solid support to bind to and remove the polypeptide from the remainder of the sample. The bound polypeptide may then be detected using a detection reagent that contains a reporter group and specifically binds to the binding agent/polypeptide complex. Such detection reagents may comprise, for example, a binding agent that specifically binds to the polypeptide or an antibody or other agent that specifically binds to the binding agent, such as an anti-immunoglobulin, protein G, protein A or a lectin. Alternatively, a competitive assay may be utilized, in which a polypeptide is labeled with a reporter group and allowed to bind to the immobilized binding agent after incubation of the binding agent with the sample. The extent to which components of the sample inhibit the binding of the labeled polypeptide to the binding agent is indicative of the reactivity of the sample with the immobilized binding agent. Suitable polypeptides for use within such assays include full length lung tumor proteins and polypeptide portions thereof to which the binding agent binds, as described above.

The solid support may be any material known to those of ordinary skill in the art to which the tumor protein may be attached. For example, the solid support may be a test well in a microtiter plate or a nitrocellulose or other suitable membrane. Alternatively, the support may be a bead or disc, such as glass, fiberglass, latex or a plastic material such as polystyrene or polyvinylchloride. The support may also be a magnetic particle or a fiber optic sensor, such as those disclosed, for example, in U.S. Pat. No. 5,359,681. The binding agent may be immobilized on the solid support using a variety of techniques known to those of skill in the art, which are amply described in the patent and scientific literature. In the context of the present invention, the term "immobilization" refers to both noncovalent association, such as adsorption, and covalent attachment (which may be a direct linkage between the agent and functional groups on the support or may be a linkage by way of a cross-linking agent). Immobilization by adsorption to a well in a microtiter plate or to a membrane is preferred. In such cases, adsorption may be achieved by contacting the binding agent, in a suitable buffer, with the solid support for a suitable amount of time. The contact time varies with temperature, but is typically between about 1 hour and about 1 day. In general, contacting a well of a plastic microtiter plate (such as polystyrene or polyvinylchloride) with an amount of binding agent ranging from about 10 ng to about 10 µg, and preferably about 100 ng to about 1 µg, is sufficient to immobilize an adequate amount of binding agent.

Covalent attachment of binding agent to a solid support may generally be achieved by first reacting the support with a bifunctional reagent that will react with both the support and a functional group, such as a hydroxyl or amino group, on the binding agent. For example, the binding agent may be covalently attached to supports having an appropriate polymer coating using benzoquinone or by condensation of an aldehyde group on the support with an amine and an active hydrogen on the binding partner (see, e.g., Pierce Immunotechnology Catalog and Handbook, 1991, at A12-A13).

In certain embodiments, the assay is a two-antibody sandwich assay. This assay may be performed by first contacting an antibody that has been immobilized on a solid support, commonly the well of a microtiter plate, with the sample, such that polypeptides within the sample are allowed to bind to the immobilized antibody. Unbound sample is then removed from the immobilized polypeptide-antibody complexes and a detection reagent (preferably a second antibody capable of binding to a different site on the polypeptide) containing a reporter group is added. The amount of detection reagent that remains bound to the solid support is then determined using a method appropriate for the specific reporter group.

More specifically, once the antibody is immobilized on the support as described above, the remaining protein binding sites on the support are typically blocked. Any suitable blocking agent known to those of ordinary skill in the art, such as bovine serum albumin or Tween 20™ (Sigma Chemical Co., St. Louis, Mo.). The immobilized antibody is then incubated with the sample, and polypeptide is allowed to bind to the antibody. The sample may be diluted with a suitable diluent, such as phosphate-buffered saline (PBS) prior to incubation. In general, an appropriate contact time (i.e., incubation time) is a period of time that is sufficient to detect the presence of polypeptide within a sample obtained from an individual with lung cancer. Preferably, the contact time is sufficient to achieve a level of binding that is at least about 95% of that achieved at equilibrium between bound and unbound polypeptide. Those of ordinary skill in the art will recognize that the time necessary to achieve equilibrium may be readily determined by assaying the level of binding that occurs over a period of time. At room temperature, an incubation time of about 30 minutes is generally sufficient.

Unbound sample may then be removed by washing the solid support with an appropriate buffer, such as PBS containing 0.1% Tween 20™. The second antibody, which contains a reporter group, may then be added to the solid support. Preferred reporter groups include those groups recited above.

The detection reagent is then incubated with the immobilized antibody-polypeptide complex for an amount of time sufficient to detect the bound polypeptide. An appropriate amount of time may generally be determined by assaying the level of binding that occurs over a period of time. Unbound detection reagent is then removed and bound detection reagent is detected using the reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products.

To determine the presence or absence of a cancer, such as lung cancer, the signal detected from the reporter group that remains bound to the solid support is generally compared to a signal that corresponds to a predetermined cut-off value. In one preferred embodiment, the cut-off value for the detection of a cancer is the average mean signal obtained when the immobilized antibody is incubated with samples from patients without the cancer. In general, a sample generating a signal that is three standard deviations above the predetermined cut-off value is considered positive for the cancer. In an alternate preferred embodiment, the cut-off value is determined using a Receiver Operator Curve, according to the method of Sackett et al., *Clinical Epidemiology: A Basic Science for Clinical Medicine*, Little Brown and Co., 1985, p. 106-7. Briefly, in this embodiment, the cut-off value may be determined from a plot of pairs of true positive rates (i.e., sensitivity) and false positive rates (100%-specificity) that correspond to each possible cut-off value for the diagnostic test result. The cut-off value on the plot that is the closest to the upper left-hand corner (i.e., the value that encloses the largest area) is the most accurate cut-off value, and a sample generating a signal that is higher than the cut-off value determined by this method may be considered positive. Alternatively, the cut-off value may be shifted to the left along the plot, to minimize the false positive rate, or to the right, to minimize the false negative rate. In general, a sample generating a signal that is higher than the cut-off value determined by this method is considered positive for a cancer.

In a related embodiment, the assay is performed in a flow-through or strip test format, wherein the binding agent is immobilized on a membrane, such as nitrocellulose. In the flow-through test, polypeptides within the sample bind to the immobilized binding agent as the sample passes through the membrane. A second, labeled binding agent then binds to the binding agent-polypeptide complex as a solution containing the second binding agent flows through the membrane. The detection of bound second binding agent may then be performed as described above. In the strip test format, one end of the membrane to which binding agent is bound is immersed in a solution containing the sample. The sample migrates along the membrane through a region containing second binding agent and to the area of immobilized binding agent. Concentration of second binding agent at the area of immobilized antibody indicates the presence of a cancer. Typically, the concentration of second binding agent at that site generates a pattern, such as a line, that can be read visually. The absence of such a pattern indicates a negative result. In general, the amount of binding agent immobilized on the membrane is selected to generate a visually discernible pattern when the biological sample contains a level of polypeptide that would be sufficient to generate a positive signal in the two-antibody sandwich assay, in the format discussed above. Preferred binding agents for use in such assays are antibodies and antigen-binding fragments thereof. Preferably, the amount of antibody immobilized on the membrane ranges from about 25 ng to about 1 µg, and more preferably from about 50 ng to about 500 ng. Such tests can typically be performed with a very small amount of biological sample.

Of course, numerous other assay protocols exist that are suitable for use with the tumor proteins or binding agents of the present invention. The above descriptions are intended to be exemplary only. For example, it will be apparent to those of ordinary skill in the art that the above protocols may be readily modified to use tumor polypeptides to detect antibodies that bind to such polypeptides in a biological sample. The detection of such tumor protein specific antibodies may correlate with the presence of a cancer.

A cancer may also, or alternatively, be detected based on the presence of T cells that specifically react with a tumor protein in a biological sample. Within certain methods, a biological sample comprising $CD4^+$ and/or $CD8^+$ T cells isolated from a patient is incubated with a tumor polypeptide, a polynucleotide encoding such a polypeptide and/or an APC that expresses at least an immunogenic portion of such a polypeptide, and the presence or absence of specific activation of the T cells is detected. Suitable biological samples include, but are not limited to, isolated T cells. For example, T cells may be isolated from a patient by routine techniques (such as by Ficoll/Hypaque density gradient centrifugation of peripheral blood lymphocytes). T cells may be incubated in vitro for 2-9 days (typically 4 days) at 37° C. with polypeptide (e.g., 5-25 µg/ml). It may be desirable to incubate another aliquot of a T cell sample in the absence of tumor polypeptide to serve as a control. For $CD4^+$ T cells, activation is preferably detected by evaluating proliferation of the T cells. For $CD8^+$ T cells, activation is preferably detected by evaluating cytolytic activity. A level of proliferation that is at least two fold greater and/or a level of cytolytic activity that is at least 20% greater than in disease-free patients indicates the presence of a cancer in the patient.

As noted above, a cancer may also, or alternatively, be detected based on the level of mRNA encoding a tumor protein in a biological sample. For example, at least two oligonucleotide primers may be employed in a polymerase chain reaction (PCR) based assay to amplify a portion of a tumor cDNA derived from a biological sample, wherein at least one of the oligonucleotide primers is specific for (i.e., hybridizes to) a polynucleotide encoding the tumor protein. The amplified cDNA is then separated and detected using techniques well known in the art, such as gel electrophoresis.

Similarly, oligonucleotide probes that specifically hybridize to a polynucleotide encoding a tumor protein may be used in a hybridization assay to detect the presence of polynucleotide encoding the tumor protein in a biological sample.

To permit hybridization under assay conditions, oligonucleotide primers and probes should comprise an oligonucleotide sequence that has at least about 60%, preferably at least about 75% and more preferably at least about 90%, identity to a portion of a polynucleotide encoding a tumor protein of the invention that is at least 10 nucleotides, and preferably at least 20 nucleotides, in length. Preferably, oligonucleotide primers and/or probes hybridize to a polynucleotide encoding a polypeptide described herein under moderately stringent conditions, as defined above. Oligonucleotide primers and/or probes which may be usefully employed in the diagnostic methods described herein preferably are at least 10-40 nucleotides in length. In a preferred embodiment, the oligonucleotide primers comprise at least 10 contiguous nucleotides, more preferably at least 15 contiguous nucleotides, of a DNA molecule having a sequence as disclosed herein. Techniques for both PCR based assays and hybridization assays are well known in the art (see, for example, Mullis et al., *Cold Spring Harbor Symp. Quant. Biol.*, 51:263, 1987; Erlich ed., *PCR Technology*, Stockton Press, NY, 1989).

One preferred assay employs RT-PCR, in which PCR is applied in conjunction with reverse transcription. Typically, RNA is extracted from a biological sample, such as biopsy tissue, and is reverse transcribed to produce cDNA molecules. PCR amplification using at least one specific primer generates a cDNA molecule, which may be separated and visualized using, for example, gel electrophoresis. Amplification may be performed on biological samples taken from a test patient and from an individual who is not afflicted with a cancer. The amplification reaction may be performed on several dilutions of cDNA spanning two orders of magnitude. A two-fold or greater increase in expression in several dilutions of the test patient sample as compared to the same dilutions of the non-cancerous sample is typically considered positive.

In another aspect of the present invention, cell capture technologies may be used in conjunction with, for example, real-time PCR to provide a more sensitive tool for detection of metastatic cells expressing lung tumor antigens. Detection of lung cancer cells in biological samples, e.g., bone marrow samples, peripheral blood, and small needle aspiration samples is desirable for diagnosis and prognosis in lung cancer patients.

Immunomagnetic beads coated with specific monoclonal antibodies to surface cell markers, or tetrameric antibody complexes, may be used to first enrich or positively select cancer cells in a sample. Various commercially available kits may be used, including Dynabeads® Epithelial Enrich (Dynal Biotech, Oslo, Norway), StemSep™ (StemCell Technologies, Inc., Vancouver, BC), and RosetteSep (StemCell Technologies). A skilled artisan will recognize that other methodologies and kits may also be used to enrich or positively select desired cell populations. Dynabeads® Epithelial Enrich contains magnetic beads coated with mAbs specific for two glycoprotein membrane antigens expressed on normal and neoplastic epithelial tissues. The coated beads may be added to a sample and the sample then applied to a magnet, thereby capturing the cells bound to the beads. The unwanted cells are washed away and the magnetically isolated cells eluted from the beads and used in further analyses.

RosetteSep can be used to enrich cells directly from a blood sample and consists of a cocktail of tetrameric antibodies that targets a variety of unwanted cells and crosslinks them to glycophorin A on red blood cells (RBC) present in the sample, forming rosettes. When centrifuged over Ficoll, targeted cells pellet along with the free RBC. The combination of antibodies in the depletion cocktail determines which cells will be removed and consequently which cells will be recovered. Antibodies that are available include, but are not limited to: CD2, CD3, CD4, CD5, CD8, CD10, CD11b, CD14, CD15, CD16, CD19, CD20, CD24, CD25, CD29, CD33, CD34, CD36, CD38, CD41, CD45, CD45RA, CD45RO, CD56, CD66B, CD66e, HLA-DR, IgE, and TCRαβ.

Additionally, it is contemplated in the present invention that mAbs specific for lung tumor antigens can be generated and used in a similar manner. For example, mAbs that bind to tumor-specific cell surface antigens may be conjugated to magnetic beads, or formulated in a tetrameric antibody complex, and used to enrich or positively select metastatic lung tumor cells from a sample. Once a sample is enriched or positively selected, cells may be lysed and RNA isolated. RNA may then be subjected to RT-PCR analysis using lung tumor-specific primers in a real-time PCR assay as described herein. One skilled in the art will recognize that enriched or selected populations of cells may be analyzed by other methods (e.g. in situ hybridization or flow cytometry).

In another embodiment, the compositions described herein may be used as markers for the progression of cancer. In this embodiment, assays as described above for the diagnosis of a cancer may be performed over time, and the change in the level of reactive polypeptide(s) or polynucleotide(s) evaluated. For example, the assays may be performed every 24-72 hours for a period of 6 months to 1 year, and thereafter performed as needed. In general, a cancer is progressing in those patients in whom the level of polypeptide or polynucleotide detected increases over time. In contrast, the cancer is not progressing when the level of reactive polypeptide or polynucleotide either remains constant or decreases with time.

Certain in vivo diagnostic assays may be performed directly on a tumor. One such assay involves contacting tumor cells with a binding agent. The bound binding agent may then be detected directly or indirectly via a reporter group. Such binding agents may also be used in histological applications. Alternatively, polynucleotide probes may be used within such applications.

As noted above, to improve sensitivity, multiple tumor protein markers may be assayed within a given sample. It will be apparent that binding agents specific for different proteins provided herein may be combined within a single assay. Further, multiple primers or probes may be used concurrently. The selection of tumor protein markers may be based on routine experiments to determine combinations that results in optimal sensitivity. In addition, or alternatively, assays for tumor proteins provided herein may be combined with assays for other known tumor antigens.

The present invention further provides kits for use within any of the above diagnostic methods. Such kits typically comprise two or more components necessary for performing a diagnostic assay. Components may be compounds, reagents, containers and/or equipment. For example, one container within a kit may contain a monoclonal antibody or fragment thereof that specifically binds to a tumor protein. Such antibodies or fragments may be provided attached to a support material, as described above. One or more additional containers may enclose elements, such as reagents or buffers, to be used in the assay. Such kits may also, or alternatively, contain a detection reagent as described above that contains a reporter group suitable for direct or indirect detection of antibody binding.

Alternatively, a kit may be designed to detect the level of mRNA encoding a tumor protein in a biological sample. Such kits generally comprise least one oligonucleotide probe or primer, as described above, that hybridizes to a polynucleotide encoding a tumor protein. Such an oligonucleotide may be used, for example, within a PCR or hybridization assay. Additional components that may be present within such kits include a second oligonucleotide and/or a diagnostic reagent or container to facilitate the detection of a polynucleotide encoding a tumor protein.

The following examples are offered by way of illustration and not by way of limitation.

EXAMPLES

Example 1

Isolation and Characterization of cDNA Sequences Encoding Lung Tumor Polypeptides This example illustrates the isolation of cDNA molecules encoding lung tumor-specific polypeptides from lung tumor cDNA libraries.

A. Isolation of cDNA Sequences from a Lung Squamous Cell Carcinoma Library

A human lung squamous cell carcinoma cDNA expression library was constructed from poly $A^+$ RNA from a pool of two patient tissues using a Superscript Plasmid System for cDNA Synthesis and Plasmid Cloning kit (BRL Life Technologies, Gaithersburg, Md.) following the manufacturer's protocol. Specifically, lung carcinoma tissues were homogenized with polytron (Kinematica, Switzerland) and total RNA was extracted using Trizol reagent (BRL Life Technologies) as directed by the manufacturer. The poly $A^+$ RNA was then purified using an oligo dT cellulose column as described in Sambrook et al., *Molecular Cloning: A Laboratory Manual*, Cold Spring Harbor Laboratories, Cold Spring Harbor, N.Y., 1989. First-strand cDNA was synthesized using the NotI/Oligo-dT18 primer. Double-stranded cDNA was synthesized, ligated with BstXI/EcoRI adaptors (Invitrogen, San Diego, Calif.) and digested with NotI. Following size fractionation with cDNA size fractionation columns (BRL Life Technologies), the cDNA was ligated into the BstXI/NotI site of pcDNA3.1 (Invitrogen) and transformed into ElectroMax *E. coli* DH10B cells (BRL Life Technologies) by electroporation.

Using the same procedure, a normal human lung cDNA expression library was prepared from a pool of four tissue specimens. The cDNA libraries were characterized by determining the number of independent colonies, the percentage of clones that carried insert, the average insert size and by sequence analysis. The lung squamous cell carcinoma library contained $2.7 \times 10^6$ independent colonies, with 100% of clones having an insert and the average insert size being 2100 base pairs. The normal lung cDNA library contained $1.4 \times 10^6$ independent colonies, with 90% of clones having inserts and the average insert size being 1800 base pairs. For both libraries, sequence analysis showed that the majority of clones had a full length cDNA sequence and were synthesized from mRNA cDNA library subtraction was performed using the above lung squamous cell carcinoma and normal lung cDNA libraries, as described by Hara et al. (*Blood*, 84:189-199, 1994) with some modifications. Specifically, a lung squamous cell carcinoma-specific subtracted cDNA library was generated as follows. Normal tissue cDNA library (80 µg) was digested with BamHI and XhoI, followed by a filling-in reaction with DNA polymerase Klenow fragment. After phenol-chloroform extraction and ethanol precipitation, the DNA was dissolved in 133 µl of $H_2O$, heat-denatured and mixed with 133 µl (133 µg) of Photoprobe biotin (Vector Laboratories, Burlingame, Calif.). As recommended by the manufacturer, the resulting mixture was irradiated with a 270 W sunlamp on ice for 20 minutes. Additional Photoprobe biotin (67 µl) was added and the biotinylation reaction was repeated. After extraction with butanol five times, the DNA was ethanol-precipitated and dissolved in 23 µl $H_2O$ to form the driver DNA.

To form the tracer DNA, 10 µg lung squamous cell carcinoma cDNA library was digested with NotI and SpeI, phenol chloroform extracted and passed through Chroma spin-400 columns (Clontech, Palo Alto, Calif.). Typically, 5 µg of cDNA was recovered after the sizing column. Following ethanol precipitation, the tracer DNA was dissolved in 5 µl $H_2O$. Tracer DNA was mixed with 15 µl driver DNA and 20 µl of 2× hybridization buffer (1.5 M NaCl/10 mM EDTA/50 mM HEPES pH 7.5/0.2% sodium dodecyl sulfate), overlaid with mineral oil, and heat-denatured completely. The sample was immediately transferred into a 68° C. water bath and incubated for 20 hours (long hybridization [LH]). The reaction mixture was then subjected to a streptavidin treatment followed by phenol/chloroform extraction. This process was repeated three more times. Subtracted DNA was precipitated, dissolved in 12 µl $H_2O$, mixed with 8 µl driver DNA and 20 µl of 2× hybridization buffer, and subjected to a hybridization at 68° C. for 2 hours (short hybridization [SH]). After removal of biotinylated double-stranded DNA, subtracted cDNA was ligated into NotI/SpeI site of chloramphenicol resistant pBCSK$^+$ (Stratagene, La Jolla, Calif.) and transformed into ElectroMax *E. coli* DH10B cells by electroporation to generate a lung squamous cell carcinoma specific subtracted cDNA library (herein after referred to as "lung subtraction I").

A second lung squamous cell carcinoma specific subtracted cDNA library (referred to as "lung subtraction II") was generated in a similar way to the lung subtraction library I, except that eight frequently recovered genes from lung subtraction I were included in the driver DNA, and 24,000 independent clones were recovered.

To analyze the subtracted cDNA libraries, plasmid DNA was prepared from 320 independent clones, randomly picked from the subtracted lung squamous cell carcinoma specific libraries. Representative cDNA clones were further characterized by DNA sequencing with a Perkin Elmer/Applied Biosystems Division Automated Sequencer Model 373A and/or Model 377 (Foster City, Calif.). The cDNA sequences for sixty isolated clones are provided in SEQ ID NO: 1-60. These sequences were compared to known sequences in the gene bank using the EMBL and GenBank databases (release 96). No significant homologies were found to the sequences provided in SEQ ID NO: 2, 3, 19, 38 and 46. The sequences of SEQ ID NO: 1, 6-8, 10-13, 15, 17, 18, 20-27, 29, 30, 32, 34-37, 39-45, 47-49, 51, 52, 54, 55 and 57-59 were found to show some homology to previously identified expressed sequence tags (ESTs). The sequences of SEQ ID NO: 9, 28, 31 and 33 were found to show some homology to previously identified non-human gene sequences and the sequences of SEQ ID NO: 4, 5, 14, 50, 53, 56 and 60 were found to show some homology to gene sequences previously identified in humans.

The subtraction procedure described above was repeated using the above lung squamous cell carcinoma cDNA library as the tracer DNA, and the above normal lung tissue cDNA library and a cDNA library from normal liver and heart (constructed from a pool of one sample of each tissue as described above), plus twenty other cDNA clones that were frequently recovered in lung subtractions I and II, as the driver DNA (lung subtraction III). The normal liver and heart cDNA library contained $1.76 \times 10^6$ independent colonies, with 100% of clones having inserts and the average insert size being 1600 base pairs. Ten additional clones were isolated (SEQ ID NO: 61-70). Comparison of these cDNA sequences with those in the gene bank as described above, revealed no significant homologies to the sequences provided in SEQ ID NO: 62 and 67. The sequences of SEQ ID NO: 61, 63-66, 68 and 69 were found to show some homology to previously isolated ESTs and the sequence provided in SEQ ID NO: 70 was found to show some homology to a previously identified rat gene.

In further studies, the subtraction procedure described above was repeated using the above lung squamous cell carcinoma cDNA library as the tracer DNA, and a cDNA library from a pool of normal lung, kidney, colon, pancreas, brain, resting PBMC, heart, skin and esophagus as the driver DNA, with esophagus cDNAs making up one third of the driver material. Since esophagus is enriched in normal epithelial cells, including differentiated squamous cells, this procedure is likely to enrich genes that are tumor specific rather than tissues specific. The cDNA sequences of 48 clones determined in this subtraction are provided in SEQ ID NO: 177-224. The sequences of SEQ ID NO: 177, 178, 180, 181, 183, 187, 192, 195-197, 208, 211, 212, 215, 216, 218 and 219 showed some homology to previously identified genes. The sequences of SEQ ID NO: 179, 182, 184-186, 188-191, 193, 194, 198-207, 209 210, 213, 214, 217, 220 and 224 showed some homology to previously determined ESTs. The sequence of SEQ ID NO: 221-223 showed no homology to any previously determined sequence.

B. Isolation of cDNA Sequences from a Lung Adenocarcinoma Library

A human lung adenocarcinoma cDNA expression library was constructed as described above. The library contained $3.2 \times 10^6$ independent colonies, with 100% of clones having an insert and the average insert size being 1500 base pairs. Library subtraction was performed as described above using the normal lung and normal liver and heart cDNA expression libraries described above as the driver DNA. Twenty-six hundred independent clones were recovered.

Initial cDNA sequence analysis from 100 independent clones revealed many ribosomal protein genes. The cDNA sequences for fifteen clones isolated in this subtraction are provided in SEQ ID NO: 71-86. Comparison of these sequences with those in the gene bank as described above revealed no significant homologies to the sequence provided in SEQ ID NO: 84. The sequences of SEQ ID NO: 71, 73, 74, 77, 78 and 80-82 were found to show some homology to previously isolated ESTs, and the sequences of SEQ ID NO: 72, 75, 76, 79, 83 and 85 were found to show some homology to previously identified human genes.

In further studies, a cDNA library (referred to as mets3616A) was constructed from a metastatic lung adenocarcinoma. The determined cDNA sequences of 25 clones sequenced at random from this library are provided in SEQ ID NO: 255-279. The mets3616A cDNA library was subtracted against a cDNA library prepared from a pool of normal lung, liver, pancreas, skin, kidney, brain and resting PBMC. To increase the specificity of the subtraction, the driver was spiked with genes that were determined to be most abundant in the mets3616A cDNA library, such as EF1-alpha, integrin-beta and anticoagulant protein PP4, as well as with cDNAs that were previously found to be differentially expressed in subtracted lung adenocarcinoma cDNA libraries. The determined cDNA sequences of 51 clones isolated from the subtracted library (referred to as mets3616A-S1) are provided in SEQ ID NO: 280-330.

Comparison of the sequences of SEQ ID NO: 255-330 with those in the public databases revealed no significant homologies to the sequences of SEQ ID NO: 255-258, 260, 262-264, 270, 272, 275, 276, 279, 281, 287, 291, 296, 300 and 310. The sequences of SEQ ID NO: 259, 261, 265-269, 271, 273, 274, 277, 278, 282-285, 288-290, 292, 294, 297-299, 301, 303-309, 313, 314, 316, 320-324 and 326-330 showed some homology to previously identified gene sequences, while the sequences of SEQ ID NO: 280, 286, 293, 302, 310, 312, 315, 317-319 and 325 showed some homology to previously isolated expressed sequence tags (ESTs).

Example 2

Determination of Tissue Specificity of Lung Tumor Polypeptides

Using gene specific primers, mRNA expression levels for seven representative lung tumor polypeptides described in Example 1 were examined in a variety of normal and tumor tissues using RT-PCR.

Briefly, total RNA was extracted from a variety of normal and tumor tissues using Trizol reagent as described above. First strand synthesis was carried out using 2 µg of total RNA with SuperScript II reverse transcriptase (BRL Life Technologies) at 42° C. for one hour. The cDNA was then amplified by PCR with gene-specific primers. To ensure the semi-quantitative nature of the RT-PCR, β-actin was used as an internal control for each of the tissues examined. 1 µl of 1:30 dilution of cDNA was employed to enable the linear range amplification of the β-actin template and was sensitive enough to reflect the differences in the initial copy numbers. Using these conditions, the β-actin levels were determined for each reverse transcription reaction from each tissue. DNA contamination was minimized by DNase treatment and by assuring a negative PCR result when using first strand cDNA that was prepared without adding reverse transcriptase.

mRNA Expression levels were examined in five different types of tumor tissue (lung squamous cell carcinoma from 3 patients, lung adenocarcinoma, colon tumor from 2 patients, breast tumor and prostate tumor), and thirteen different normal tissues (lung from 4 donors, prostate, brain, kidney, liver, ovary, skeletal muscle, skin, small intestine, stomach, myocardium, retina and testes). Using a 10-fold amount of cDNA, the antigen LST-S1-90 (SEQ ID NO: 3) was found to be expressed at high levels in lung squamous cell carcinoma and in breast tumor, and at low to undetectable levels in the other tissues examined.

The antigen LST-S2-68 (SEQ ID NO: 15) appears to be specific to lung and breast tumor, however, expression was also detected in normal kidney. Antigens LST-S1-169 (SEQ ID NO: 6) and LST-S1-133 (SEQ ID NO: 5) appear to be very abundant in lung tissues (both normal and tumor), with the expression of these two genes being decreased in most of the normal tissues tested. Both LST-S1-169 and LST-S1-133 were also expressed in breast and colon tumors. Antigens LST-S1-6 (SEQ ID NO: 7) and LST-S2-12-5F (SEQ ID NO: 47) did not show tumor or tissue specific expression, with the expression of LST-S1-28 being rare and only detectable in a few tissues. The antigen LST-S3-7 (SEQ ID NO: 63) showed lung and breast tumor specific expression, with its message only being detected in normal testes when the PCR was performed for 30 cycles. Lower level expression was detected in some normal tissues when the cycle number was increased to 35. Antigen LST-S3-13 (SEQ ID NO: 66) was found to be expressed in 3 out of 4 lung tumors, one breast tumor and both colon tumor samples. Its expression in normal tissues was lower compared to tumors, and was only detected in 1 out of 4 normal lung tissues and in normal tissues from kidney, ovary and retina. Expression of antigens LST-S3-4 (SEQ ID NO: 62) and LST-S3-14 (SEQ ID NO: 67) was rare and did not show any tissue or tumor specificity. Consistent with Northern blot analyses, the RT-PCR results on antigen LAT-S1-A-10A (SEQ ID NO: 78) suggested that its expression is high in lung, colon, stomach and small intestine tissues, including lung and colon tumors, whereas its expression was low or undetectable in other tissues.

A total of 2002 cDNA fragments isolated in lung subtractions I, II and III, described above, were colony PCR amplified and their mRNA expression levels in lung tumor, normal lung, and various other normal and tumor tissues were determined using microarray technology (Synteni, Palo Alto, Calif.). Briefly, the PCR amplification products were dotted onto slides in an array format, with each product occupying a unique location in the array. mRNA was extracted from the tissue sample to be tested, reverse transcribed, and fluorescent-labeled cDNA probes were generated. The microarrays were probed with the labeled cDNA probes, the slides scanned and fluorescence intensity was measured. This intensity correlates with the hybridization intensity. Seventeen non-redundant cDNA clones showed over-expression in lung squamous tumors, with expression in normal tissues tested (lung, skin, lymph node, colon, liver, pancreas, breast, heart, bone marrow, large intestine, kidney, stomach, brain, small intestine, bladder and salivary gland) being either undetectable, or 10-fold less compared to lung squamous tumors. The determined cDNA sequences for the clone L513S are provided in SEQ ID NO: 87 and 88; those for L514S are provided in SEQ ID NO: 89 and 90; those for L516S in SEQ ID NO: 91 and 92; that for L517S in SEQ ID NO: 93; that for L519S in SEQ ID NO: 94; those for L520S in SEQ ID NO: 95 and 96; those for L521S in SEQ ID NO: 97 and 98; that for L522S in SEQ ID NO: 99; that for L523S in SEQ ID NO: 100; that for L524S in SEQ ID NO: 101; that for L525S in SEQ ID NO: 102; that for L526S in SEQ ID NO: 103; that for L527S in SEQ ID NO: 104; that for L528S in SEQ ID NO: 105; that for L529S in SEQ ID NO: 106; and those for L530S in SEQ ID NO: 107 and 108. Additionally, the full-length cDNA sequence for L530S is provided in SEQ ID NO: 151, with the corresponding amino acid sequence being provided in SEQ ID NO: 152. L530S shows homology to a splice variant of a p53 tumor suppressor homologue, p63. The cDNA sequences of 7 known isoforms of p63 are provided in SEQ ID NO: 331-337, with the corresponding amino acid sequences being provided in SEQ ID NO: 338-344, respectively.

Due to polymorphisms, the clone L531S appears to have two forms. A first determined full-length cDNA sequence for L531S is provided in SEQ ID NO: 109, with the corresponding amino acid sequence being provided in SEQ ID NO: 110. A second determined full-length cDNA sequence for L531 S is provided in SEQ ID NO: 111, with the corresponding amino acid sequence being provided in SEQ ID NO: 112. The sequence of SEQ ID NO: 111 is identical to that of SEQ ID NO: 109, except that it contains a 27 bp insertion. Similarly, L514S has two alternatively spliced forms; the first variant cDNA is listed as SEQ ID NO: 153, with the corresponding amino acid sequence being provided in SEQ ID NO: 155. The full-length cDNA for the second variant form of L514S is provided in SEQ ID NO: 154, with the corresponding amino acid sequence being provided in SEQ ID NO: 156.

Full length cloning for L524S (SEQ ID NO: 101) yielded two variants (SEQ ID NO: 163 and 164) with the corresponding amino acid sequences of SEQ ID NO: 165 and 166, respectively. Both variants have been shown to encode parathyroid hormone-related peptide.

Attempts to isolate the full-length cDNA for L519S, resulted in the isolation of the extended cDNA sequence provided in SEQ ID NO: 173, which contains a potential open reading frame. The amino acid sequence encoded by the sequence of SEQ ID NO: 173 is provided in SEQ ID NO: 174. Additionally, the full-length cDNA sequence for the clone of SEQ ID NO: 100 (known as L523S), a known gene, is provided in SEQ ID NO: 175, with the corresponding amino acid sequence being provided in SEQ ID NO: 176. In further studies, a full-length cDNA sequence for L523S was isolated from a L523S-positive tumor cDNA library by PCR amplification using gene specific primers designed from the sequence of SEQ ID NO: 175. The determined full-length cDNA sequence is provided in SEQ ID NO: 347. The amino acid sequence encoded by this sequence is provided in SEQ ID NO: 348. This protein sequence differs from the previously published protein sequence at two amino acid positions, namely at positions 158 and 410.

Comparison of the sequences of L514S and L531S (SEQ ID NO: 87 and 88, and 109, respectively) with those in the gene bank, as described above, revealed no significant homologies to known sequences. The sequences of L513S, L516S, L517S, L519S, L520S and L530S (SEQ ID NO: 87 and 88, 91 and 92, 93, 94, 95 and 96, 107 and 108, respectively) were found to show some homology to previously identified ESTs. The sequences of L521S, L522S, L523S, L524S, L525S, L526S, L527S, L528S and L529S (SEQ ID NO: 97 and 98, 99, 100, 101, 102, 103, 104, 105, and 106, respectively) were found to represent known genes. The determined full-length cDNA sequence for L520S is provided in SEQ ID NO: 113, with the corresponding amino acid sequence being provided in SEQ ID NO: 114. Subsequent microarray analysis showed L520S to be overexpressed in breast tumors in addition to lung squamous tumors.

Further analysis demonstrated that L529S (SEQ ID NO: 106 and 115), L525S (SEQ ID NO: 102 and 120) and L527S (SEQ ID NO: 104) are cytoskeletal components and potentially squamous cell specific proteins. L529S is connexin 26, a gap junction protein. It was found to be highly expressed in one lung squamous tumor, referred to as 9688T, and moderately over-expressed in two others. However, lower level expression of connexin 26 is also detectable in normal skin, colon, liver and stomach. The over-expression of connexin 26 in some breast tumors has been reported and a mutated form of L529S may result in over-expression in lung tumors. L525S is plakophilin 1, a desmosomal protein found in plaque-bearing adhering junctions of the skin. Expression levels for L525S mRNA was highly elevated in three out of four lung squamous tumors tested, and in normal skin. L527S has been identified as keratin 6 isoform, type II 58 Kd keratin and cytokeratin 13, and shows over-expression in squamous tumors and low expression in normal skin, breast and colon tissues. Keratin and keratin-related genes have been extensively documented as potential markers for lung cancer including CYFRA2.1 (Pastor, A., et al, *Eur. Respir. J.*, 10:603-609, 1997). L513S (SEQ ID NO: 87 and 88) shows moderate over-expression in several tumor tissues tested, and encodes a protein that was first isolated as a pemphigus vulgaris antigen.

L520S (SEQ ID NO: 95 and 96) and L521S (SEQ ID NO: 97 and 98) are highly expressed in lung squamous tumors, with L520S being up-regulated in normal salivary gland and L521S being over-expressed in normal skin. Both belong to a family of small proline rich proteins and represent markers for fully differentiated squamous cells. L521 S has been described as a specific marker for lung squamous tumor (Hu, R., et al, *Lung Cancer*, 20:25-30, 1998). L515S (SEQ ID NO: 162) encodes IGF-β2 and L516S is an aldose reductase homologue. Both are moderately expressed in lung squamous tumors and in normal colon. Notably, L516S (SEQ ID NO: 91 and 92) is up-regulated in metastatic tumors but not primary lung adenocarcinoma, an indication of its potential role in metatasis and a potential prognostic marker. L522S (SEQ ID NO: 99) is moderately over-expressed in lung squamous tumors with minimum expression in normal tissues. L522S has been shown to belong to a class IV alcohol dehydrogenase, ADH7, and its expression profile suggests it is a squamous cell specific antigen. L523S (SEQ ID NO: 100) is moderately over-expressed in lung squamous tumor, human pancreatic cancer cell lines and pancreatic cancer tissues, suggesting this gene may be a shared antigen between pancreatic and lung squamous cell cancer.

L524S (SEQ ID NO: 101) is over-expressed in the majority of squamous tumors tested and is homologous with parathyroid hormone-related peptide (PTHrP), which is best known to cause humoral hypercalcaemia associated with malignant tumors such as leukemia, prostate and breast cancer. It is also believed that PTHrP is most commonly associated with squamous carcinoma of lung and rarely with lung adenocarcinoma (Davidson, L. A., et al, *J. Pathol.*, 178: 398-401, 1996). L528S (SEQ ID NO: 105) is highly over-expressed in two lung squamous tumors with moderate expression in two other squamous tumors, one lung adenocarcinoma and some normal tissues, including skin, lymph nodes, heart, stomach and lung. It encodes the NMB gene that is similar to the precursor of melanocyte specific gene Pmel17, which is reported to be preferentially expressed in low-metastatic potential melanoma cell lines. This suggests that L528S may be a shared antigen in both melanoma and lung squamous cell carcinoma. L526S (SEQ ID NO: 103) was overexpressed in all lung squamous cell tumor tissues tested and has been shown to share homology with a gene (ATM) in which a mutation causes ataxia telangiectasia, a genetic disorder in humans causing a predisposition to cancer, among other symptoms. ATM encodes a protein that activates a p53 mediated cell-cycle checkpoint through direct binding and phosphorylation of the p53 molecule. Approximately 40% of lung cancers are associated with p53 mutations, and it is speculated that over-expression of ATM is a result of compensation for loss of p53 function, but it is unknown whether over-expression is the cause of result of lung squamous cell carcinoma. Additionally, expression of L526S (ATM) is also detected in a metastatic but not lung adenocarcinoma, suggesting a role in metastasis.

Expression of L523S (SEQ ID NO: 175), was examined by real time RT-PCR as described above. In a first study using a panel of lung squamous tumors, L523S was found to be expressed in 4/7 lung squamous tumors, 2/3 head and neck squamous tumors and 2/2 lung adenocarcinomas, with low level expression being observed in skeletal muscle, soft palate and tonsil. In a second study using a lung adenocarcinoma panel, expression of L523S was observed in 4/9 primary adenocarcinomas, 2/2 lung pleural effusions, 1/1 metastatic lung adenocarcinomas and 2/2 lung squamous tumors, with little expression being observed in normal tissues.

Expression of L523S in lung tumors and various normal tissues was also examined by Northern blot analysis, using standard techniques. In a first study, L523S was found to be expressed in a number of lung adenocarcinomas and squamous cell carcinomas, as well as normal tonsil. No expression was observed in normal lung. In a second study using a normal tissue blot (referred to as HB-12) from Clontech, no expression was observed in brain, skeletal muscle, colon, thymus, spleen, kidney, liver, small intestine, lung or PBMC, although there was strong expression in placenta.

Example 3

Isolation and Characterization of Lung Tumor Polypeptides by PCR-Based Subtraction Eight hundred and fifty seven clones from a cDNA subtraction library, containing cDNA from a pool of two human lung squamous tumors subtracted against eight normal human tissue cDNAs including lung, PBMC, brain, heart, kidney, liver, pancreas, and skin, (Clontech, Palo Alto, Calif.) were derived and submitted to a first round of PCR amplification. This library was subjected to a second round of PCR amplification, following the manufacturer's protocol. The resulting cDNA fragments were subcloned into the P7-Adv vector (Clontech, Palo Alto, Calif.) and transformed into DH5α *E. coli* (Gibco, BRL). DNA was isolated from independent clones and sequenced using a Perkin Elmer/Applied Biosystems Division Automated Sequencer Model 373A.

One hundred and sixty two positive clones were sequenced. Comparison of the DNA sequences of these clones with those in the EMBL and GenBank databases, as described above, revealed no significant homologies to 13 of these clones, hereinafter referred to as Contigs 13, 16, 17, 19, 22, 24, 29, 47, 49, 56-59. The determined cDNA sequences for these clones are provided in SEQ ID NO: 125, 127-129, 131-133, 142, 144, 148-150, and 157, respectively. Contigs 1, 3-5, 7-10, 12, 11, 15, 20, 31, 33, 38, 39, 41, 43, 44, 45, 48, 50, 53, 54 (SEQ ID NO: 115-124, 126, 130, 134-141, 143, 145-147, respectively) were found to show some degree of homology to previously identified DNA sequences. Contig 57 (SEQ ID NO: 149) was found to represent the clone L519S (SEQ ID NO: 94) disclosed in U.S. patent application Ser. No. 09/123,912, filed Jul. 27, 1998. To the best of the inventors' knowledge, none of these sequences have been previously shown to be differentially over-expressed in lung tumors.

mRNA expression levels for representative clones in lung tumor tissues, normal lung tissues (n=4), resting PBMC, salivary gland, heart, stomach, lymph nodes, skeletal muscle, soft palate, small intestine, large intestine, bronchial, bladder, tonsil, kidney, esophagus, bone marrow, colon, adrenal gland, pancreas, and skin (all derived from human) were determined by RT-PCR as described above. Expression levels using microarray technology, as described above, were examined in one sample of each tissue type unless otherwise indicated.

Contig 3 (SEQ ID NO: 116) was found to be highly expressed in all head and neck squamous cell tumors tested (17/17), and expressed in the majority (8/12) of lung squamous tumors, (high expression in 7/12, moderate in 2/12, and low in 2/12), while showing negative expression for 2/4 normal lung tissues and low expression in the remaining two samples. Contig 3 showed moderate expression in skin and soft palate, and lowered expression levels in resting PBMC, large intestine, salivary gland, tonsil, pancreas, esophagus, and colon. Contig 11 (SEQ ID NO: 124) was found to be expressed in all head and neck squamous cell tumors tested (17/17), with high levels of expression being seen in 14/17 tumors, and moderately levels of expression being seen in 3/17 tumors. Additionally, high expression was seen in 3/12 lung squamous tumors and moderate expression in 4/12 lung squamous tumors. Contig 11 was negative for 3/4 normal lung samples, with the remaining sample having only low expression. Contig 11 showed low to moderate reactivity to salivary gland, soft palate, bladder, tonsil, skin, esophagus, and large intestine. Contig 13 (SEQ ID NO: 125) was found to be expressed in all head and neck squamous cell tumors tested (17/17), with high expression in 12/17, and moderate expression in 5/17. Contig 13 was expressed in 7/12 lung squamous tumors, with high expression in 4/12 and moderate expression in three samples. Analysis of normal lung samples showed negative expression for 2/4 and low to moderate expression in the remaining two samples. Contig 13 showed low to moderate reactivity to resting PBMC, salivary gland, bladder, pancreas, tonsil, skin, esophagus, and large intestine, as well as high expression in soft palate. Subsequent full-length cloning efforts revealed that contig 13 (also known as L761P) maps to the 3' untranslated region of the hSec10p gene. The full-length sequence for this gene is set forth in SEQ ID NO: 368, and encodes the protein set forth in SEQ ID NO: 369.

Contig 16 (SEQ ID NO: 127) was found to be moderately expressed in several head and neck squamous cell tumors (6/17) and one lung squamous tumor, while showing no expression in any normal lung samples tested. Contig 16 showed low reactivity to resting PBMC, large intestine, skin, salivary gland, and soft palate. Contig 17 (SEQ ID NO: 128) was shown to be expressed in all head and neck squamous cell tumors tested (17/17) (highly expressed in 5/17, and moderately expressed in 12/17). Determination of expression levels in lung squamous tumors showed one tumor sample with high expression and 3/12 with moderate levels. Contig 17 was negative for 2/4 normal lung samples, with the remaining samples having only low expression. Additionally, low level expression was found in esophagus and soft palate. Contig 19 (SEQ ID NO: 129) was found to be expressed in most head and neck squamous cell tumors tested (11/17); with two samples having high expression levels, 6/17 showing moderate expression, and low expression being found in 3/17. Testing in lung squamous tumors revealed only moderate expression in 3/12 samples. Expression levels in 2/4 of normal lung samples were negative, the two other samples having only low expression. Contig 19 showed low expression levels in esophagus, resting PBMC, salivary gland, bladder, soft palate and pancreas.

Contig 22 (SEQ ID NO: 131), was shown to be expressed in most head and neck squamous cell tumors tested (13/17) with high expression in four of these samples, moderate expression in 6/17, and low expression in 3/17. Expression levels in lung squamous tumors were found to be moderate to high for 3/12 tissues tested, with negative expression in two normal lung samples and low expression in two other samples (n=4). Contig 22 showed low expression in skin, salivary gland and soft palate. Similarly, Contig 24 (SEQ ID NO: 132) was found to be expressed in most head and neck squamous cell tumors tested (13/17) with high expression in three of these samples, moderate expression in 6/17, and low expression in 4/17. Expression levels in lung squamous tumors were found to be moderate to high for 3/12 tissues tested, with negative expression for three normal lung samples and low expression in one sample (n=4). Contig 24 showed low expression in skin, salivary gland and soft palate. Contig 29 (SEQ ID NO: 133) was expressed in nearly all head and neck squamous cell tumors tested (16/17): highly expressed in 4/17, moderately expressed in 11/17, with low expression in one sample. Also, it was moderately expressed in 3/12 lung squamous tumors, while being negative for 2/4 normal lung samples. Contig 29 showed low to moderate expression in large intestine, skin, salivary gland, pancreas, tonsil, heart and soft palate. Contig 47 (SEQ ID NO: 142) was expressed in most head and neck squamous cell tumors tested (12/17): moderate expression in 10/17, and low expression in two samples. In lung squamous tumors, it was highly expressed in one sample and moderately expressed in two others (n=13). Contig 47 was negative for 2/4 normal lung samples, with the remaining two samples having moderate expression. Also, Contig 47 showed moderate expression in large intestine, and pancreas, and low expression in skin, salivary gland, soft palate, stomach, bladder, resting PBMC, and tonsil.

Contig 48 (SEQ ID NO: 143) was expressed in all head and neck squamous cell tumors tested (17/17): highly expressed in 8/17 and moderately expressed in 7/17, with low expression in two samples. Expression levels in lung squamous tumors were high to moderate in three samples (n=13). Contig 48 was negative for one out of four normal lung samples, the remaining showing low or moderate expression. Contig 48 showed moderate expression in soft palate, large intestine, pancreas, and bladder, and low expression in esophagus, salivary gland, resting PBMC, and heart. Contig 49 (SEQ ID NO: 144) was expressed at low to moderate levels in 6/17 head and neck squamous cell tumors tested. Expression levels in lung squamous tumors were moderate in three samples (n=13). Contig 49 was negative for 2/4 normal lung samples, the remaining samples showing low expression. Moderate expression levels in skin, salivary gland, large intestine, pancreas, bladder and resting PBMC were shown, as well as low expression in soft palate, lymph nodes, and tonsil. Contig 56 (SEQ ID NO: 148) was expressed in low to moderate levels in 3/17 head and neck squamous cell tumors tested, and in lung squamous tumors, showing low to moderate levels in three out of thirteen samples. Notably, low expression levels were detected in one adenocarcinoma lung tumor sample (n=2). Contig 56 was negative for 3/4 normal lung samples, and showed moderate expression levels in only large intestine, and low expression in salivary gland, soft palate, pancreas, bladder, and resting PBMC. Contig 58, also known as L769P, (SEQ ID NO: 150) was expressed at moderate levels in 11/17 head and neck squamous cell tumors tested and low expression in one additional sample. Expression in lung squamous tumors showed low to moderate levels in three out of thirteen samples. Contig 58 was negative for 3/4 normal lung samples, with one sample having low expression. Moderate expression levels in skin, large intestine, and resting PBMC were demonstrated, as well as low expression in salivary gland, soft palate, pancreas, and bladder. Contig 59 (SEQ ID NO: 157) was expressed in some head, neck, and lung squamous tumors. Low level expression of Contig 59 was also detected in salivary gland and large intestine.

The full-length cDNA sequence for Contig 22, also referred to as L763P, is provided in SEQ ID NO: 158, with the corresponding amino acid sequence being provided in SEQ ID NO: 159. Real-time RT-PCR analysis of L763P revealed that it is highly expressed in 3/4 lung squamous tumors as well as 4/4 head and neck squamous tumors, with low level expression being observed in normal brain, skin, soft pallet and trachea. Subsequent database searches revealed that the sequence of SEQ ID NO: 158 contains a mutation, resulting in a frameshift in the corresponding protein sequence. A second cDNA sequence for L763P is provided in SEQ ID NO: 345, with the corresponding amino acid sequence being provided in SEQ ID NO: 346. The sequences of SEQ ID NO: 159 and 346 are identical with the exception of the C-terminal 33 amino acids of SEQ ID NO: 159.

The full-length cDNA sequence incorporating Contigs 17, 19, and 24, referred to as L762P, is provided in SEQ ID NO: 160, with the corresponding amino acid sequence being provided in SEQ ID NO: 161. Further analysis of L762P has determined it to be a type I membrane protein and two additional variants have been sequenced. Variant 1 (SEQ ID NO: 167, with the corresponding amino acid sequence in SEQ ID NO: 169) is an alternatively spliced form of SEQ ID NO: 160 resulting in deletion of 503 nucleotides, as well as deletion of a short segment of the expressed protein. Variant 2 (SEQ ID NO: 168, with the corresponding amino acid sequence in SEQ ID NO: 170) has a two nucleotide deletion at the 3' coding region in comparison to SEQ ID NO: 160, resulting in a secreted form of the expressed protein. Real-time RT-PCR analysis of L762P revealed that is over-expressed in 3/4 lung squamous tumors and 4/4 head & neck tumors, with low level expression being observed in normal skin, soft pallet and trachea.

An epitope of L762P was identified as having the sequence KPGHWTYTLNNTHHSLQALK (SEQ ID NO: 382), which corresponds to amino acids 571-590 of SEQ ID NO:161.

The full-length cDNA sequence for contig 56 (SEQ ID NO: 148), also referred to as L773P, is provided in SEQ ID NO: 171, with the amino acid sequence in SEQ ID NO: 172. L773P was found to be identical to dihydroxyl dehydrogenase at the 3' portion of the gene, with divergent 5' sequence. As a result, the 69 N-terminal amino acids are unique. The cDNA sequence encoding the 69 N-terminal amino acids is provided in SEQ ID NO: 349, with the N-terminal amino acid sequence being provided in SEQ ID NO: 350. Real-time PCR revealed that L773P is highly expressed in lung squamous tumor and lung adenocarcinoma, with no detectable expression in normal tissues. Subsequent Northern blot analysis of L773P demonstrated that this transcript is differentially over-expressed in squamous tumors and detected at approximately 1.6 Kb in primary lung tumor tissue and approximately 1.3 Kb in primary head and neck tumor tissue.

Subsequent microarray analysis has shown Contig 58, also referred to as L769S (SEQ ID NO: 150), to be over-expressed in breast tumors in addition to lung squamous tumors.

Example 4

Isolation and Characterization of Lung Tumor Polypeptides by PCR-Based Subtraction Seven hundred and sixty clones from a cDNA subtraction library, containing cDNA from a pool of two human lung primary adenocarcinomas subtracted against a pool of nine normal human tissue cDNAs including skin, colon, lung, esophagus, brain, kidney, spleen, pancreas and liver, (Clontech, Palo Alto, Calif.) were derived and submitted to a first round of PCR amplification. This library (referred to as ALT-1) was subjected to a second round of PCR amplification, following the manufacturer's protocol. The expression levels of these 760 cDNA clones in lung tumor, normal lung, and various other normal and tumor tissues, were examined using microarray technology (Incyte, Palo Alto, Calif.). Briefly, the PCR amplification products were dotted onto slides in an array format, with each product occupying a unique location in the array. mRNA was extracted from the tissue sample to be tested, reverse transcribed, and fluorescent-labeled cDNA probes were generated. The microarrays were probed with the labeled cDNA probes, the slides scanned and fluorescence intensity was measured. This intensity correlates with the hybridization intensity. A total of 118 clones, of which 55 were unique, were found to be over-expressed in lung tumor tissue, with expression in normal tissues tested (lung, skin, lymph node, colon, liver, pancreas, breast, heart, bone marrow, large intestine, kidney, stomach, brain, small intestine, bladder and salivary gland) being either undetectable, or at significantly lower levels. One of these clones, having the sequence as provided in SEQ ID NO:420 (clone #19014), shows homology to a previously identified clone, L773P. Clone L773P has the full-length cDNA sequence provided in SEQ ID NO:171 and the amino acid sequence provided in SEQ ID NO:172 The isolation of clone #19014 is also described in co-pending U.S. patent application Ser. No. 09/285,479, filed Apr. 2, 1999.

Example 5

Synthesis of Polypeptides

Polypeptides may be synthesized on a Perkin Elmer/Applied Biosystems Division 430A peptide synthesizer using FMOC chemistry with HPTU (O-Benzotriazole-N,N,N',N'-tetramethyluronium hexafluorophosphate) activation. A Gly-Cys-Gly sequence may be attached to the amino terminus of the peptide to provide a method of conjugation, binding to an immobilized surface, or labeling of the peptide. Cleavage of the peptides from the solid support is carried out using the following cleavage mixture: trifluoroacetic acid:ethanedithiol:thioanisole:water:phenol (40:1:2:2:3). After cleaving for 2 hours, the peptides are precipitated in cold methyl-t-butyl-ether. The peptide pellets are then dissolved in water containing 0.1% trifluoroacetic acid (TFA) and lyophilized prior to purification by C18 reverse phase HPLC. A gradient of 0%-60% acetonitrile (containing 0.1% TFA) in water (containing 0.1% TFA) may be used to elute the peptides. Following lyophilization of the pure fractions, the peptides are characterized using electrospray or other types of mass spectrometry and by amino acid analysis.

Example 6

Preparation of Antibodies Against Lung Cancer Antigens

Polyclonal antibodies against the lung cancer antigens L514S, L528S, L531S, L523 and L773P (SEQ ID NO: 155, 225, 112, 176 and 171, respectively) were prepared as follows.

Rabbits were immunized with recombinant protein expressed in and purified from *E. coli* as described below. For the initial immunization, 400 μg of antigen combined with muramyl dipeptide (MDP) was injected subcutaneously (S.C.). Animals were boosted S.C. 4 weeks later with 200 μg of antigen mixed with incomplete Freund's Adjuvant (IFA). Subsequent boosts of 100 μg of antigen mixed with IFA were injected S.C. as necessary to induce high antibody titer responses. Serum bleeds from immunized rabbits were tested for antigen-specific reactivity using ELISA assays with purified protein. Polyclonal antibodies against L514S, L528S, L531S, L523S and L773P were affinity purified from high titer polyclonal sera using purified protein attached to a solid support.

Immunohistochemical analysis using polyclonal antibodies against L514S was performed on a panel of 5 lung tumor samples, 5 normal lung tissue samples and normal colon, kidney, liver, brain and bone marrow. Specifically, tissue samples were fixed in formalin solution for 24 hours and embedded in paraffin before being sliced into 10 micron sections. Tissue sections were permeabilized and incubated with antibody for 1 hr. HRP-labeled anti-mouse followed by incubation with DAB chromogen was used to visualize L514S immunoreactivity. L514S was found to be highly expressed in lung tumor tissue with little or no expression being observed in normal lung, brain or bone marrow. Light staining was observed in colon (epithelial crypt cells positive) and kidney (tubules positive). Staining was seen in normal liver but no mRNA has been detected in this tissue making this result suspect.

Using the same procedure, immunohistochemical analysis using polyclonal antibodies against L528S demonstrated staining in lung tumor and normal lung samples, light staining in colon and kidney, and no staining in liver and heart.

Immunohistochemical analysis using polyclonal antibodies against L531S demonstrated staining in lung tumor samples, light membrane staining in most normal lung samples, epithelial staining in colon, tubule staining in kidney, ductal epithelial staining in liver and no staining in heart.

Immunohistochemical analysis using polyclonal antibodies against L523S demonstrated staining in all lung cancer samples tested but no staining in normal lung, kidney, liver, colon, bone marrow or cerebellum.

Generation of polyclonal anti-sera against L762P (SEQ ID NO: 169 and 170) was performed as follows. 400 micrograms of lung antigen was combined with 100 micrograms of muramyldipeptide (MDP). An equal volume of Incomplete Freund's Adjuvant (IFA) was added and then mixed until an emulsion was formed. Rabbits were injected subcutaneously (S.C.). After four weeks the animals were injected S.C. with 200 micrograms of antigen mixed with an equal volume of IFA. Every four weeks animals were boosted with 100 micrograms of antigen. Seven days following each boost the animal was bled. Sera was generated by incubating the blood at 4° C. for 12-24 hours followed by centrifugation.

Characterization of polyclonal antisera was carried out as follows. Ninety-six well plates were coated with antigen by incubing with 50 microliters (typically 1 microgram) at 4° C. for 20 hrs. 250 microliters of BSA blocking buffer was added to the wells and incubated at room temperature for 2 hrs. Plates were washed 6 times with PBS/0.01% Tween. Rabbit sera was diluted in PBS and 50 microliters of diluted sera was added to each well and incubated at room temperature for 30 min. Plates were washed as described above before addition of 50 microliters of goat anti-rabbit horse radish peroxidase (HRP) at a 1:10000 dilution and incubation at room temperature for 30 min. Plates were washed as described above and 100 µl of TMB Microwell Peroxidase Substrate was added to each well. Following a 15 minute incubation in the dark at room temperature, the colorimetric reaction was stopped with 100 µl 1N $H_2SO_4$ and read immediately at 450 nm. Antisera showed strong reactivity to antigen L762P.

Immunohistochemical analysis using polyclonal antibodies against L762P demonstrated staining in all lung cancer samples tested, some light staining in the bronchiole epithelium of normal lung, tubule staining in kidney, light epithelial staining in colon and no staining in heart or liver.

In order to evaluate L773P protein expression in various tissues, immunohistochemistry (IHC) analysis was performed using an affinity purified L773P polyclonal antibody. Briefly, tissue samples were fixed in formalin solution for 12-24 hrs and embedded in paraffin before being sliced into 8 micron sections. Steam heat induced epitope retrieval (SHIER) in 0.1 M sodiuym citrate buffer (pH 6.0) was used for optimal staining conditions. Sections were incubated with 10% serum/PBS for 5 minutes. Primary antibody was added to each section for 25 minutes at indicated concentrations followed by 25 minute incubation with either anti-rabbit or anti-mouse biotinylated antibody. Endogenous peroxidase activitiy was blocked by three 1.5 minute incubations with hydrogen peroxidase. The avidin biotin complex/horse radish peroxidase (ABC/HRP) system was used along with DAB chromogen to visualize L773P expression. Slides were counterstainied with hematoxylin to visualize cell nuclei. Using this approach, L773P protein was detected in 6/8 lung tumors, 4/6 normal lung samples (very light staining in some cases), 1/1 kidney samples (very light staining), 0/1 heart samples, 1/1 colon samples (very light staining) and 0/1 liver samples.

Example 7

Peptide Priming of Mice and Propagation of CTL Lines

Immunogenic peptides from the lung cancer antigen L762P (SEQ ID NO: 161) for HLA-A2/$K^b$-restricted CD8+ T cells were identified as follows.

The location of HLA-A2 binding peptides within the lung cancer antigen L762P (SEQ ID NO: 161) was predicted using a computer program which predicts peptides sequences likely to being to HLA-A*0201 by fitting to the known peptide binding motif for HLA-A*0201 (Rupert et al. (1993) Cell 74:929; Rammensee et al. (1995) Immunogenetics 41:178-228). A series of 19 synthetic peptides corresponding to a selected subset of the predicted HLA-A*0201 binding peptides was prepared as described above.

Mice expressing the transgene for human HLA A2/$K^b$ (provided by Dr L. Sherman, The Scripps Research Institute, La Jolla, Calif.) were immunized with the synthetic peptides, as described by Theobald et al., Proc. Natl. Acad. Sci. USA 92:11993-11997, 1995, with the following modifications. Mice were immunized with 50 µg of L726P peptide and 120 µg of an I-$A^b$ binding peptide derived from hepatitis B virus protein emulsified in incomplete Freund's adjuvant. Three weeks later these mice were sacrificed and single cell suspensions prepared. Cells were then resuspended at $7 \times 10^6$ cells/ml in complete media (RPMI-1640; Gibco BRL, Gaithersburg, Md.) containing 10% FCS, 2 mM Glutamine (Gibco BRL), sodium pyruvate (Gibco BRL), non-essential amino acids (Gibco BRL), $2 \times 10^{-5}$ M 2-mercaptoethanol, 50 U/ml penicillin and streptomycin, and cultured in the presence of irradiated (3000 rads) L762P peptide (5 µg/ml) and 10 mg/ml $B_2$-microglobulin-(3 µg/ml) LPS blasts (A2 transgenic spleens cells cultured in the presence of 7 µg/ml dextran sulfate and 25 µg/ml LPS for 3 days). After six days, cells ($5 \times 10^5$/ml) were restimulated with $2.5 \times 10^6$/ml peptide-pulsed irradiated (20,000 rads) EL4A2Kb cells (Sherman et al, Science 258:815-818, 1992) and $5 \times 10^6$/ml irradiated (3000 rads) A2/$K^b$-transgenic spleen feeder cells. Cells were cultured in the presence of 10 U/ml IL-2. Cells were restimulated on a weekly basis as described, in preparation for cloning the line.

Peptide-specific cell lines were cloned by limiting dilution analysis with irradiated (20,000 rads) L762P peptide-pulsed EL4 A2Kb tumor cells ($1 \times 10^4$ cells/well) as stimulators and irradiated (3000 rads) A2/$K^b$-transgenic spleen cells as feeders ($5 \times 10^5$ cells/well) grown in the presence of 10 U/ml IL-2. On day 7, cells were restimulated as before. On day 14, clones that were growing were isolated and maintained in culture.

Cell lines specific for the peptides L762P-87 (SEQ ID NO: 226; corresponding to amino acids 87-95 of SEQ ID NO: 161), L762P-145 (SEQ ID NO: 227; corresponding to amino acids 145-153 of SEQ ID NO: 161), L762P-585 (SEQ ID NO: 228; corresponding to amino acids 585-593 of SEQ ID NO: 161), L762P-425 (SEQ ID NO: 229; corresponding to amino acids 425-433 of SEQ ID NO: 161), L762P(10)-424 (SEQ ID NO: 230; corresponding to amino acids 424-433 of SEQ ID NO: 161) and L762P(10)-458 (SEQ ID NO: 231; corresponding to amino acids 458-467 of SEQ ID NO: 161) demonstrated significantly higher reactivity (as measured by percent specific lysis) against L762P peptide-pulsed EL4-A2/$K^b$ tumor target cells than control peptide-pulsed EL4-A2/$K^b$ tumor target cells.

Example 8

Identification of CD4 Immunogenic T Cell Epitopes Derived from the Lung Cancer Antigen L762P CD4 T cell lines specific for the antigen L762P (SEQ ID NO: 161) were generated as follows.

A series of 28 overlapping peptides were synthesized that spanned approximately 50% of the L762P sequence. For priming, peptides were combined into pools of 4-5 peptides, pulsed at 20 micrograms/ml into dendritic cells for 24 hours. The dendritic cells were then washed and mixed with positively selected CD4+ T cells in 96 well U-bottomed plates. Forty cultures were generated for each peptide pool. Cultures were restimulated weekly with fresh dendritic cells loaded with peptide pools. Following a total of 3 stimulation cycles, cells were rested for an additional week and tested for specificity to antigen presenting cells (APC) pulsed with peptide pools using interferon-gamma ELISA and proliferation assays. For these assays, adherent monocytes loaded with either the relevant peptide pool or an irrelevant peptide were used as APC. T cell lines that appeared to specifically recognize L762P peptide pools both by cytokine release and proliferation were identified for each pool. Emphasis was placed on identifying T cells with proliferative responses. T cell lines that demonstrated either both L762P-specific cytokine secretion and proliferation, or strong proliferation alone were further expanded to be tested for recognition of individual peptides from the pools, as well as for recognition of recombinant L762P. The source of recombinant L762P was E. coli, and the material was partially purified and endotoxin positive. These studies employed 10 micrograms of individual peptides, 10 or 2 micrograms of an irrelevant peptide, and 2 or 0.5 micrograms of either L762P protein or an irrelevant, equally impure, E. coli generated recombinant protein. Significant interferon-gamma production and CD4 T cell proliferation was induced by a number of L762P-derived peptides in each pool. The amino acid sequences for these peptides are provided in SEQ ID NO: 232-251. These peptides correspond to amino acids 661-680, 676-696, 526-545, 874-893, 811-830, 871-891, 856-875, 826-845, 795-815, 736-755, 706-725, 706-725, 691-710, 601-620, 571-590, 556-575, 616-635, 646-665, 631-650, 541-560 and 586-605, respectively, of SEQ ID NO: 161.

CD4 T cell lines that demonstrated specificity for individual L762P-derived peptides were further expanded by stimulation with the relevant peptide at 10 micrograms/ml. Two weeks post-stimulation, T cell lines were tested using both proliferation and IFN-gamma ELISA assays for recognition of the specific peptide. A number of previously identified T cells continued to demonstrate L762P-peptide specific activity. Each of these lines was further expanded on the relevant peptide and, following two weeks of expansion, tested for specific recognition of the L762P-peptide in titration experiments, as well as for recognition of recombinant E. coli-derived L762P protein. For these experiments, autologous adherent monocytes were pulsed with either the relevant L762P-derived peptide, an irrelevant mammaglobin-derived peptide, recombinant E. coli-derived L762P (approx. 50% pure), or an irrelevant E. coli-derived protein. The majority of T cell lines were found to show low affinity for the relevant peptide, since specific proliferation and IFN-gamma ratios dramatically decreased as L762P peptide was diluted. However, four lines were identified that demonstrated significant activity even at 0.1 micrograms/ml peptide. Each of these lines (referred to as A/D5, D/F5, E/A7 and E/B6) also appeared to specifically proliferate in response to the E. coli-derived L762P protein preparation, but not in response to the irrelevant protein preparation. The amino acid sequences of the L762P-derived peptides recognized by these lines are provided in SEQ ID NO: 234, 249, 236 and 245, respectively. No protein specific IFN-gamma was detected for any of the lines. Lines A/D5, E/A7 and E/B6 were cloned on autologous adherent monocytes pulsed with the relevant peptide at 0.1 (A/D5 and E/A7) or 1 (D/F5) microgram/ml. Following growth, clones were tested for specificity for the relevant peptide. Numerous clones specific for the relevant peptide were identified for lines A/D5 and E/A7.

Example 9

Protein Expression of Lung Tumor-Specific Antigens

A. Expression of L514S in E. coli

The lung tumor antigen L514S (SEQ ID NO: 89) was subcloned into the expression vector pE32b at NcoI and NotI sites, and transformed into E. coli using standard techniques. The protein was expressed from residues 3-153 of SEQ ID NO: 89. The expressed amino acid sequence and the corresponding DNA sequence are provided in SEQ ID NO: 252 and 253, respectively.

B. Expression of L762P

Amino acids 32-944 of the lung tumor antigen L762P (SEQ ID NO: 161), with a 6× His Tag, were subcloned into a modified pET28 expression vector, using kanamycin resistance, and transformed into BL21 CodonPlus using standard techniques. Low to moderate levels of expression were observed. The determined DNA sequence of the L762P expression construct is provided in SEQ ID NO: 254.

Example 10

Identification of MHC Class II Restricting Allele for L762P Peptide-Specific Responses A panel of HLA mismatched antigen presenting cells (APC) were used to identify the MHC class II restricting allele for the L762P-peptide specific responses of CD4 T cell clones derived from lines that recognized L762P peptide and recombinant protein. Clones from two lines, AD-5 and EA-7, were tested as described below. The AD-5 derived clones were found to be restricted by the HLA-DRB-1101 allele, and an EA-7 derived clone was found to be restricted by the HLA DRB-0701 or DQB1-0202 allele. Identification of the restriction allele allows targeting of vaccine therapies using the defined peptide to individuals that express the relevant class II allele. Knowing the relevant restricting allele will also enable clinical monitoring for responses to the defined peptide since only individuals that express the relevant allele will be monitored.

CD4 T cell clones derived from line AD-5 and EA-7 were stimulated on autologous APC pulsed with the specific peptide at 10 pg/ml, and tested for recognition of autologous APC (from donor D72) as well as against a panel of APC partially matched with D72 at class II alleles. Table 2 shows the HLA class typing of the APC tested. Adherent monocytes (generated by 2 hour adherence) from four different donors, referred to as D45, D187, D208, and D326, were used as APC in these experiments. Autologous APC were not included in the experiment. Each of the APC were pulsed with the relevant peptide (5a for AD-5 and 3e for 3A-7) or the irrelevant mammoglobin peptide at 10 μg/ml, and cultures were established for 10,000 T cells and about 20,000 APC/well. As shown in Table 3, specific proliferation and cytokine production could be detected only when partially matched donor cells were used as APC. Based on the MHC typing analysis, these results strongly suggest that the restricting allele for the L762-specific response of the AD-5 derived clones is HLA-DRB-1101 and for the EA-7 derived clone the restricting allele is HLA DRB-0701 or DQB1-0202.

TABLE 2

| | HLA Typing of APC | | | |
|---|---|---|---|---|
| DONOR | DR | DR | DQ | DQ |
| D72 | B1-1101 | B1-0701 | B1-0202 | B1-0301 |
| D45 | −3 | −15 | B1-0201 | B1-0602 |
| D187 | −4 | −15 | −1 | −7 |
| D208 | B1-1101 | B1-0407 | −3 | −3 |
| D326 | B1-0301 | B1-0701 | B1-0202 | B1-0201 |

TABLE 3

L762P Peptide Responses Map to HLA DR Alleles

| | AD-5 | | | | | | | | | | | |
|---|---|---|---|---|---|---|---|---|---|---|---|---|
| | A11 | | B10 | | C10 | | C11 | | E6 | | F1 | |
| Donor | Prol | γ-IFN | Prol | γ-IFN | Prol | γ-IFN | Prol | γ-IFN | Prol | γ-IFN | Prol | γ-IFN |
| D72 DR-0701, -1101, DQ-0202, -7 | 46 | | 31 | | 34 | | 24 | | 31 | | 40 | |
| D45 DR-3, -15, DQ-1, -0201 | 3.2 | 1.7 | 5.5 | 1.2 | 3.3 | 1 | 1.0 | 1.5 | 1.1 | 1.1 | 1.6 | 1.1 |
| D187 DR-4, -15, DQ-1, -7 | 1.4 | 1.2 | 1.3 | 1 | 1.4 | 1.1 | 1.4 | 1.7 | 1.0 | 1.1 | 1.4 | 1.2 |
| D208 DR-4, -1101, DQ-3 | 138 | 13 | 38 | 5.4 | 18.8 | 10 | 14.6 | 4.6 | 15.3 | 6.1 | 45.9 | 8.6 |
| D326 DR-3, -0701, DQ-0202 | 0.7 | 4 | 0.3 | 1 | 0.3 | 1.4 | 1.0 | 2 | 0.8 | 1.1 | 0.3 | 1.1 |

| | AD-5 | | | | | | | | EA-7 | |
|---|---|---|---|---|---|---|---|---|---|---|
| | F9 | | G8 | | G9 | | G10 | | G12 | |
| Donor | Prol | γ-IFN | Prol | γ-IFN | Prol | γ-IFN | Prol | γ-IFN | Prol | γ-IFN |
| D72 DR-0701, -1101, DQ-0202, -7 | 55 | | 45 | | 43 | | 91 | | 10 | |
| D45 DR-3, -15, DQ-1, -0201 | 1.4 | 1.3 | 0.2 | 1.1 | 1.1 | 1.1 | 1.2 | 1.5 | 0.8 | 1.1 |
| D187 DR-4, -15, DQ-1, -7 | 1.2 | 1.1 | 0.9 | 1 | 1.0 | 1 | 1.0 | 1.6 | 0.5 | 1 |
| D208 DR-4, -1101, DQ-3 | 73.3 | 14.1 | 38.0 | 7.7 | 174.3 | 16.1 | 113.6 | 19.6 | 0.8 | 1 |
| D326 DR-3, -0701, DQ-0202 | 0.7 | 1.1 | 0.6 | 1.2 | 0.4 | 1 | 1.2 | 5 | 14.1 | 6.8 |

Example 11

Fusion Proteins of N-Terminal and C-Terminal Portions of L763P

In another embodiment, a *Mycobacterium tuberculosis*-derived polynucleotide, referred to as Ra12, is linked to at least an immunogenic portion of a polynucleotide of this invention. Ra12 compositions and methods for their use in enhancing expression of heterologous polynucleotide sequences are described in U.S. Patent Application 60/158,585, the disclosure of which is incorporated herein by reference in its entirety. Briefly, Ra12 refers to a polynucleotide region that is a subsequence of a *Mycobacterium tuberculosis* MTB32A nucleic acid. MTB32A is a serine protease of 32 KD molecular weight encoded by a gene in virulent and avirulent strains of *M. tuberculosis*. The nucleotide sequence and amino acid sequence of MTB32A have been described (for example, U.S. Patent Application 60/158,585; see also, Skeiky et al., *Infection and Immun.* (1999) 67:3998-4007, incorporated herein by reference). Surprisingly, it was discovered that a 14 KD C-terminal fragment of the MTB32A coding sequence expresses at high levels on its own and remains as a soluble protein throughout the purification process. Moreover, this fragment may enhance the immunogenicity of heterologous antigenic polypeptides with which it is fused. This 14 KD C-terminal fragment of the MTB32A is referred to herein as Ra12 and represents a fragment comprising some or all of amino acid residues 192 to 323 of MTB32A.

Recombinant nucleic acids which encode a fusion polypeptide comprising a Ra12 polypeptide and a heterologous lung tumor polypeptide of interest, can be readily constructed by conventional genetic engineering techniques. Recombinant nucleic acids are constructed so that, preferably, a Ra12 polynucleotide sequence is located 5' to a selected heterologous lung tumor polynucleotide sequence. It may also be appropriate to place a Ra12 polynucleotide sequence 3' to a selected heterologous polynucleotide sequence or to insert a heterologous polynucleotide sequence into a site within a Ra12 polynucleotide sequence.

In addition, any suitable polynucleotide that encodes a Ra12 or a portion or other variant thereof can be used in constructing recombinant fusion polynucleotides comprising Ra12 and one or more lung tumor polynucleotides disclosed herein. Preferred Ra12 polynucleotides generally comprise at least about 15 consecutive nucleotides, at least about 30 nucleotides, at least about 60 nucleotides, at least about 100 nucleotides, at least about 200 nucleotides, or at least about 300 nucleotides that encode a portion of a Ra12 polypeptide.

Ra12 polynucleotides may comprise a native sequence (i.e., an endogenous sequence that encodes a Ra12 polypeptide or a portion thereof) or may comprise a variant of such a sequence. Ra12 polynucleotide variants may contain one or more substitutions, additions, deletions and/or insertions such that the biological activity of the encoded fusion polypeptide is not substantially diminished, relative to a fusion polypeptide comprising a native Ra12 polypeptide. Variants preferably exhibit at least about 70% identity, more preferably at least about 80% identity and most preferably at least about 90% identity to a polynucleotide sequence that encodes a native Ra12 polypeptide or a portion thereof.

Two specific embodiments of fusions between Ra12 and antigens of the present invention are described in this example.

A. N-Terminal Portion of L763P

A fusion protein of full-length Ra12 and the N-terminal portion of L763P (referred to as L763P-N; amino acid residues 1-130 of SEQ ID NO: 159) was expressed as a single recombinant protein in *E. coli*. The cDNA for the N-terminal portion was obtained by PCR with a cDNA for the full length L763P and primers L763F3 (5' CGGCGAAT-TCATGGATTGGGGGACGCTGC; SEQ ID NO: 383) and 1763RV3 (5' CGGCCTCGAGTCACCCCTCTATC-CGAACCTTCTGC; SEQ ID NO: 384). The PCR product with expected size was recovered from agarose gel, digested with restriction enzymes EcoRI and XhoI, and cloned into the corresponding sites in the expression vector pCRX1. The sequence for the fusion of full-length of Ra12 and L763P-N was confirmed by DNA sequencing. The determined cDNA sequence is provided in SEQ ID NO:351, with the corresponding amino acid sequence being provided in SEQ ID NO: 352).

B. C-Terminal Portion of L763P

A fusion protein of full-length Ra12 and the C-terminal portion of L763P (referred to as L763P-C; amino acid residues 100-262 of SEQ ID NO: 159) was expressed as a single recombinant protein in *E. coli*. The cDNA of the C-terminal portion of L763P was obtained by PCR with a cDNA for the full length of L763P and primers L763F4 (5' CGGCGAATTCCACGAACCACTCGCAAGTTCAG; SEQ ID NO: 385) and L763RV4 (5' CGGCTCGAG-TTAGCTTGGGCCTGTGATTGC; SEQ ID NO: 386). The PCR product with expected size was recovered from agarose gel, digested with restriction enzymes EcoRI and XhoI, and cloned into the corresponding sites in the expression vector pCRX1. The sequence for the fusion of full-length Ra12 and L763P-C was confirmed by DNA sequencing. The determined DNA sequence is provided in SEQ ID NO:353, with the corresponding amino acid sequence being provided in SEQ ID NO: 354.

The recombinant proteins described in this example are useful for the preparation of vaccines, for antibody therapeutics, and for diagnosis of lung tumors.

Example 12

Expression in *E. Coli* of L762P His Tag Fusion Protein

PCR was performed on the L762P coding region with the following primers:

Forward primer starting at amino acid 32.

PDM-278 5'ggagtacagcftcaagacaatggg 3' (SEQ ID NO:355) Tm 57° C.

Reverse primer including natural stop codon after amino acid 920, creating EcoRI site PDM-280 5'ccatgggaattcattataataattttgttcc 3' (SEQ ID NO:356) TM55° C.

The PCR product was digested with EcoRI restriction enzyme, gel purified and then cloned into pPDM His, a modified pET28 vector with a His tag in frame, which had been digested with Eco72I and EcoRI restriction enzymes. The correct construct was confirmed by DNA sequence analysis and then transformed into BL21 (DE3) pLys S and BL21 (DE3) CodonPlus RIL expression hosts.

The protein sequence of expressed recombinant L762P is shown in SEQ ID NO:357, and the DNA sequence is shown in SEQ ID NO:358.

Example 13

Expression in *E. Coli* of a L773PA His Tag Fusion Protein

The L773PA coding region (encoding amino acids 2-71 of SEQ ID NO: 172) was PCR amplified using the following primers:

Forward primer for L773PA starting at amino acid 2:

PDM-299 5'tggcagccctcttcttcaagtggc 3' (SEQ ID NO:359) TM63° C.

Reverse primer for L773PA creating artificial stop codon after amino acid 70:

PDM-355 5'cgccagaattcatcaaacaaatctgttagcacc 3' (SEQ ID NO:360) TM62° C.

The resulting PCR product was digested with EcoRI restriction enzyme, gel purified and then cloned into pPDM His, a modified pET28 vector with a His tag in frame, which had been digested with Eco72I and EcoRI restriction enzymes. The correct construct was confirmed by DNA sequence analysis and transformed into BL21 (DE3) pLys S and BL21 (DE3) CodonPlus RIL expression hosts.

The protein sequence of expressed recombinant L773PA is shown in SEQ ID NO:361, and the DNA sequence is shown in SEQ ID NO:362.

Example 14

Identification of Epitopes Derived from Lung Tumor Specific Polypeptides

A series of peptides from the L773P amino acid sequence (SEQ ID NO: 172) were synthesized and used in in vitro priming experiments to generate peptide-specific CD4 T cells. These peptides were 20-mers that overlapped by 15 amino acids and corresponded to amino acids 1-69 of the L773P protein. This region has been demonstrated to be tumor-specific. Following three in vitro stimulations, CD4 T cell lines were identified that produced IFNγ in response to the stimulating peptide but not the control peptide. Some of these T cell lines demonstrated recognition of recombinant L773P and L773PA (tumor-specific region) proteins.

To perform the experiments, a total of eleven 20-mer peptides (SEQ ID NO: 363, 365 and 387-395) overlapping by 15 amino acids and derived from the N-terminal tumor-specific region of L773P (corresponding to amino acids 1-69 of SEQ ID NO:172) were generated by standard procedures. Dendritic cells were derived from PBMC of a normal donor using GMCSF and IL-4 by standard protocol. Purified CD4 T cells were generated from the same donor as the dendritic cells using MACS beads and negative selection of PBMCs. Dendritic cells were pulsed overnight with the individual 20-mer peptides at a concentration of 10 µg/ml. Pulsed dendritic cells were washed and plated at $1 \times 10^4$/well of a 96-well U-bottom plates, and purified CD4 cells were added at $1 \times 10^5$ well. Cultures were supplemented with 10 ng/ml IL-6 and 5 ng/ml IL-12, and incubated at 37° C. Cultures were re-stimulated as above on a weekly basis using as APC dendritic cells generated and pulsed as above, supplemented with 5 ng/ml IL-7 and 10 µg/ml IL-2. Following 3 in vitro stimulation cycles, cell lines (each corresponding to one well) were tested for cytokine production in response to the stimulating peptide vs. an irrelevant peptide.

A small number of individual CD4 T cell lines (9/528) demonstrated cytokine release (IFNγ) in response to the stimulating peptide but not to control peptide. The CD4 T cell lines that demonstrated specific activity were restimulated on the appropriate L773P peptide and reassayed using autologous dendritic cells pulsed with 10 µg/ml of the appropriate L773P peptide, an irrelevant control peptide, recombinant L773P protein (amino acids 2-364, made in *E. coli*), recombinant L773PA (amino acids 2-71, made in *E. coli*), or an appropriate control protein (L3E, made in *E. coli*). Three of the nine lines tested (1-3C, 1-6G, and 4-12B) recognized the appropriate L773P peptide as well as recombinant L773P and L773PA. Four of the lines tested (4-8A, 4-8E, 4-12D, and 4-12E) recognized the appropriate L773P peptide only. Two of the lines tested (5-6F and 9-3B) demonstrated non-specific activity.

These results demonstrate that the peptide sequences MWQPLFFKWLLSCCPGSSQI (amino acids 1-20 of SEQ ID NO: 172; SEQ ID NO:363) and GSSQIAAAASTQPED-DINTQ (amino acids 16-35 of SEQ ID NO: 172; SEQ ID NO: 365) may represent naturally processed epitopes of L773P, which are capable of stimulating human class II MHC-restricted CD4 T cell responses.

In subsequent studies, the above epitope mapping experiment was repeated using a different donor. Again, some of the resulting T cell lines were found to respond to peptide and recombinant protein. An additional peptide was found to be naturally processed. Specifically, purified CD4 cells were stimulated on a total of eleven 20-mer peptides overlapping by 15 amino acids (SEQ ID NO: 363, 387, 388, 365 and 389-395, respectively). The priming was carried out as described above, except that a peptide concentration of 0.5 ug/mL rather than 10 ug/mL was employed. In the initial screen of the cell lines 9 of the 528 lines released at least a three-fold greater level of IFN-gamma with stimulating peptide vs. control peptide. These 9 lines were restimulated on the appropriate peptide and then tested on dendritic cells pulsed with a titration of appropriate peptide (10 ug/mL, 1 ug/mL and 0.1 ug/mL), and 10 ug/mL of a control peptide. Six of the 9 lines recognized recombinant L773P as well as peptide. The six lines referred to as 1-1E, 1-2E, 1-4H, 1-6A, 1-6G and 2-12B recognized L773PA and the appropriate peptide. These results demonstrate that the peptides of SEQ ID NO: 363 and 387 represent naturally processed epitopes of L773P.

Using the procedures described above, CD4+ T cell responses were generated from PBMC of normal donors using dendritic cells pulsed with overlapping 20-mer peptides (SEQ ID NO: 396-419) spanning the L523S polypeptide sequence (SEQ ID NO: 176). A number of CD4+ T cells demonstrated reactivity with the priming peptides as well as with L523S recombinant protein, with the dominant reactivity of these lines being within the peptides 4, 7 and 21 (SEQ ID NO: 399, 402 and 416; corresponding to amino acids 30-39, 60-79 and 200-219, respectively, of SEQ ID NO: 176).

Epitopes within the scope of the invention include epitopes restricted by other class II MHC molecules. In addition, variants of the peptide can be produced wherein one or more amino acids are altered such that there is no effect on the ability of the peptides to bind to MHC molecules, no effect on their ability to elicit T cell responses, and no effect on the ability of the elicited T cells to recognize recombinant protein.

Example 15

Surface Expression of L762P and Antibody Epitopes thereof

Rabbits were immunized with full-length histidine-tagged L762P protein generated in *E. coli*. Sera was isolated from rabbits and screened for specific recognition of L762P in ELISA assays. One polyclonal serum, referred to as 2692L, was identified that specifically recognized recombinant L762P protein. The 2692L anti-L762P polyclonal antibodies were purified from the serum by affinity purification using L762P affinity columns. Although L762P is expressed in a subset of primary lung tumor samples, expression appears to be lost in established lung tumor cell lines. Therefore, to characterize surface expression of L762P, a retrovirus construct that expresses L762P was used to transduce primary human fibroblasts as well as 3 lung tumor cell lines (522-23, HTB, and 343T). Transduced lines were selected and expanded to examine L762P surface expression by FACS analysis. For this analysis, non-transduced and transduced cells were harvested using cell dissociation medium, and incubated with 10-50 micrograms/ml of either affinity purified anti-L762P or irrelevant antisera. Following a 30 minute incubation on ice, cells were washed and incubated with a secondary, FITC conjugated, anti rabbit IgG antibody as above. Cells were washed, resuspended in buffer with Propidium Iodide (PI) and examined by FACS using an Excalibur fluorescence activated cell sorter. For FACS analysis, PI-positive (i.e. dead/permeabilized cells) were excluded. The polyclonal anti-L762P sera specifically recognized and bound to the surface of L762P-transduced cells but not the non-transduced counterparts. These results demonstrate that L762P is localized to the cell surface of both fibroblasts as well as lung tumor cells.

To identify the peptide epitopes recognized by 2692L, an epitope mapping approach was pursued. A series of overlapping 19-21 mers (5 amino acid overlap) was synthesized that spanned the C terminal portion of L762P (amino acids 481-894 of SEQ ID NO: 161). In an initial experiment peptides were tested in pools. Specific reactivity with the L762P antiserum was observed with pools A, B, C, and E. To identify the specific peptides recognized by the antiserum, flat bottom 96 well microtiter plates were coated with individual peptides at 10 microgram/ml for 2 hours at 37° C. Wells were then aspirated and blocked with phosphate buffered saline containing 5% (w/v) milk for 2 hours at 37° C., and subsequently washed in PBS containing 0.1% Tween 20 (PBST). Purified rabbit anti-L762P serum 2692L was added at 200 or 20 ng/well to triplicate wells in PBST and incubated overnight at room temperature. This was followed by washing 6 times with PBST and subsequently incubating with HRP-conjugated donkey anti rabbit IgG (H+L)Affinipure F(ab') fragment at 1:2,000 for 60 minutes. Plates were then washed, and incubated in tetramethyl benzidine substrate. Reactions were stopped by the addition of 1N sulfuric acid and plates were read at 450/570 nm using an ELISA plate reader.

The resulting data, presented in Table 4 below, demonstrates that the L762P antisera recognized at least 6 distinct peptide epitopes from the 3' half of L762P.

TABLE 4

ELISA activity (OD 450-570)

| Peptide (starting amino acid of L762P) | pool | 200 ng polyclonal serum | 20 ng polyclonal serum |
| --- | --- | --- | --- |
| A (481) | A | 1.76 | 1.0 |
| B (495) | A | 0.14 | .06 |
| C (511) | E | 0.47 | 0.18 |
| D (526) | E | 0.11 | 0.09 |
| E (541) | A | 0.11 | 0.04 |
| F (556) | A | 0.04 | 0.02 |
| G (571) | A | 0.06 | 0.02 |
| H (586) | B | 0.1 | 0.03 |
| I (601) | B | 0.25 | 0.06 |
| J (616) | B | 0.1 | 0.03 |
| K (631) | E | 0.1 | 0.08 |
| L (646) | B | 0.28 | 0.12 |
| M (661) | B | 0.14 | 0.03 |
| N (676) | C | 0.12 | 0.1 |
| O (691) | C | 1.1 | 0.23 |
| P (706) | C | 0.1 | 0.03 |
| Q (721) | C | 0.11 | 0.05 |
| R (736) | E | 0.12 | 0.04 |
| S (751) | C | 0.15 | 0.06 |
| U (781) | D | 0.12 | 0.06 |
| V (795) | F | 0.07 | 0.05 |
| X (826) | D | 0.1 | 0.03 |
| Y (841) | D | 0.17 | 0.07 |
| Z (856) | D | 0.16 | 0.08 |
| AA (871) | F | 0.17 | 0.05 |
| BB (874) | F | 0.14 | 0.11 |
| No peptide |  | 0.15 | 0.045 |

Individual peptides were identified from each of the pools, and additionally a weak reactivity was identified with peptide BB from pool F. The relevant peptide epitopes are summarized in the Table 5 below. The amino acid sequences for peptides BB, O, L, I, A and C are provided in SEQ ID NO: 376-381, respectively, with the corresponding cDNA sequences being provided in SEQ ID NO: 373, 370, 372, 374, 371 and 375, respectively.

TABLE 5

ELISA activity (OD 450–570)

| Peptide | Nucleotides of L762P | Amino acids of L762P | Sequence | pool | 200 ng | 20 ng |
| --- | --- | --- | --- | --- | --- | --- |
| A | 1441–1500 | 481–500 | SRISSGTGDIFQQHIQLEST | A | 1.76 | 1.0 |
| C | 1531–1590 | 511–530 | KNTVTVDNTVGNDTMFLVTW | E | 0.47 | 0.18 |
| I | 1801–1860 | 601–620 | AVPPATVEAFVERDSLHFPH | B | 0.25 | 0.06 |
| L | 1936–1955 | 646–665 | PETGDPVTLRLLDDGAGADV | B | 0.28 | 0.12 |
| O | 2071–2130 | 691–710 | VNHSPSISTPAHSIPGSHAMIL | C | 1.1 | 0.23 |
| BB | 2620–2679 | 874–893 | LQSAVSNIAQAPLFIPPNSD | F | 0.14 | 0.11 |
| None | — | — | — | — | 0.15 | 0.05 |

Example 16

Detection of Antibodies Against Lung Tumor Antigens in Patient Sera

Antibodies specific for the lung tumor antigens L773PA (SEQ ID NO:361), L514S (SEQ ID NO:155 and 156), L523S (SEQ ID NO:176), L762P (SEQ ID NO:161) and L763P (SEQ ID NO:159) were shown to be present in effusion fluid or sera of lung cancer patients but not in normal donors. More specifically, the presence of antibodies against L773PA, L514S, L523S, L762P and L763P in effusion fluid obtained from lung cancer patients and in sera from normal donors was detected by ELISA using recombinant proteins and HRP-conjugated anti-human Ig. Briefly, each protein (100 ng) was coated in 96-well plate at pH 9.5. In parallel, BSA (bovine serum albumin) was also coated as a control protein. The signals ([S], absorbance measured at 405 nm) against BSA ([N]) were determined. The results of these studies are shown in Table 6, wherein – represents [S]/[N]<2; +/– represents [S]/[N]>2; ++ represents [S]/[N]>3; and +++ represents [S]/[N]>5.

TABLE 6

Detection of Antibodies Against Lung Tumor Antigens

| | L514S | L523S | L762P | L763P | L773PA |
|---|---|---|---|---|---|
| Effusion fluid | | | | | |
| #1 | +++ | ++ | ++ | – | ++ |
| #2 | – | – | +/– | ++ | +/– |
| #3 | – | – | – | – | +/– |
| #4 | +/– | ++ | +/– | – | +/– |
| #5 | +/– | +++ | +/– | +/– | ++ |
| #7 | – | +/– | – | – | +/– |
| #8 | – | +++ | – | – | ++ |
| #10 | – | ++ | +/– | +/– | – |
| #11 | +/– | ++ | ++ | – | ++ |
| #12 | +++ | +/– | – | +/– | +/– |
| #13 | – | +/– | – | – | +/– |
| #14 | – | +++ | +/– | +/– | ++ |
| #15 | +/– | ++ | +/– | – | ++ |
| #17 | – | +/– | – | – | +/– |
| #18 | – | ++ | – | – | – |
| #19 | – | +/– | – | – | +/– |
| #20 | +/– | +/– | +/– | – | +/– |
| Normal sera | | | | | |
| #21 | – | +/– | – | – | – |
| #22 | – | – | – | – | – |
| #23 | – | – | – | – | +/– |
| #24 | – | +/– | – | – | – |
| #25 | +/– | +/– | – | – | +/– |

Using Western blot analyses, antibodies against L523S were found to be present in 3 out of 4 samples of effusion fluid from lung cancer patients, with no L523S antibodies being detected in the three samples of normal sera tested.

Example 17

Expression in *E. Coli* of a L514S His Tag Fusion Protein

PCR was performed on the L514S-13160 coding region with the following primers:

Forward primer PDM-278 5' cacactagtgtccgcgtggcggc-ctac 3' (SEQ ID NO:421) Tm 67° C.

Reverse primer PDM-280 5' catgagaattcatcacatgccct-tgaaggctccc 3' (SEQ ID NO:422) TM 66° C.

The PCR conditions were as follows:
10 µl 10×Pfu buffer
1.0 µl 10 mM dNTPs
2.0 µl 10 µM each primer
83 µl sterile water
1.5 µl Pfu DNA polymerase (Stratagene, La Jolla, Calif.)
50 ng DNA
96° C. for 2 minutes, 96° C. for 20 seconds, 66° C. for 15 seconds, 72° C. for 1 minute with 40 cycles and then 72° C. for 4 minutes.

The PCR product was digested with EcoRI restriction enzyme, gel purified and then cloned into pPDM His, a modified pET28 vector with a His tag in frame, which had been digested with Eco72I and EcoRI restriction enzymes. The correct construct was confirmed by DNA sequence analysis and then transformed into BL21 CodonPlus (Stratagene, La Jolla, Calif.) cells for expression.

The amino acid sequence of expressed recombinant L514S is shown in SEQ ID NO:423, and the DNA coding region sequence is shown in SEQ ID NO:424.

Example 18

Expression in *E. Coli* of a L523S His Tag Fusion Protein

PCR was performed on the L523S coding region with the following primers:

Forward primer PDM-414 5' aacaaactgtatatcggaaacct-cagcgagaa 3' (SEQ ID NO:425) Tm 62° C.

Reverse primer PDM-415 5' ccatagaattcattacttccgtct-tgactgagg 3' (SEQ ID NO:426) TM 62° C.

The PCR conditions were as follows:
10 µl 10×Pfu buffer
1.0 µl 10 mM dNTPs
2.0 µl 10 µM each primer
83 µl sterile water
1.5 µl Pfu DNA polymerase (Stratagene, La Jolla, Calif.)
5 ng DNA
96° C. for 2 minutes, 96° C. for 20 seconds, 62° C. for 15 seconds, 72° C. for 4 minutes with 40 cycles and then 72° C. for 4 minutes.

The PCR product was digested with EcoRI restriction enzyme, gel purified and then cloned into pPDM His, a modified pET28 vector with a His tag in frame, which had been digested with Eco72I and EcoRI restriction enzymes. The correct construct was confirmed by DNA sequence analysis and then transformed into BL21 CodonPlus (Stratagene, La Jolla, Calif.) cells for expression.

The amino acid sequence of expressed recombinant L523S is shown in SEQ ID NO:427, and the DNA coding region sequence is shown in SEQ ID NO:428.

Example 19

Expression in *E. Coli* of a L762PA His Tag Fusion Protein

PCR was performed on the L762PA coding region (L762PA is missing the signal sequence, the C-terminal transmembrane domain and the cytoplasmic tail) with the following primers:

Forward primer PDM-278 5'ggagtacagcttcaacagaatggg 3' (SEQ ID NO:355) Tm 57° C.

Reverse primer PDM-279 5'ccatggaattcattatttcaatataa-gataatctc 3' (SEQ ID NO:429) TM56° C.

The PCR conditions were as follows:
10 µl 10×Pfu buffer
1.0 µl 10 mM dNTPs
2.0 µl 10 µM each primer
83 µl sterile water
1.5 µl Pfu DNA polymerase (Stratagene, La Jolla, Calif.)
50 ηg DNA
96° C. for 2 minutes, 96° C. for 20 seconds, 55° C. for 15 seconds, 72° C. for 5 minutes with 40 cycles and then 72° C. for 4 minutes.

The PCR product was digested with EcoRI restriction enzyme, gel purified and then cloned into pPDM His, a modified pET28 vector with a His tag in frame, which had been digested with Eco72I and EcoRI restriction enzymes. The correct construct was confirmed by DNA sequence analysis and then transformed into BL21 pLys S (Novagen, Madison, Wis.) cells for expression.

The amino acid sequence of expressed recombinant L762PA is shown in SEQ ID NO:430, and the DNA coding region sequence is shown in SEQ ID NO:431.

Example 20

Expression in *E. Coli* of a L773P His Tag Fusion Protein

PCR was performed on the L773P coding region with the following primers:
Forward primer PDM-299 5' tggcagccctcttcttcaagtggc 3' (SEQ ID NO:359) TM 63° C.
Reverse primer PDM-300 5' cgcctgctcgagtcattaatattcatcagaaatgg 3' (SEQ ID NO:432) TM 63° C.
The PCR conditions were as follows:
10 µl 10×Pfu buffer
1.0 µl 10 mM dNTPs
2.0 µl 10 µM each primer
83 µl sterile water
1.5 µl Pfu DNA polymerase (Stratagene, La Jolla, Calif.)
50 ηg DNA
96° C. for 2 minutes, 96° C. for 20 seconds, 63° C. for 15 seconds, 72° C. for 2 minutes 15 seconds with 40 cycles and then 72° C. for 4 minutes.

The PCR product was digested with EcoRI restriction enzyme, gel purified and then cloned into pPDM His, a modified pET28 vector with a His tag in frame, which had been digested with Eco72I and EcoRI restriction enzymes. The correct construct was confirmed by DNA sequence analysis and then transformed into BL21 pLys S (Novagen, Madison, Wis.) and BL21 CodonPlus (Stratagene, La Jolla, Calif.) cells for expression.

The amino acid sequence of expressed recombinant L773P is shown in SEQ ID NO:433, and the DNA coding region sequence is shown in SEQ ID NO:434.

Example 21

Cloning and Sequencing of a T-Cell Receptor Clone for the Lung Specific Antigen L762P T cell receptor (TCR) alpha and beta chains from a CD4 T cell clone specific for the lung specific antigen L762P were cloned and sequence. Basically, total mRNA from 2×10^6 cells from CTL clone 4H6 was isolated using Trizol reagent and cDNA was synthesized using Ready-to go kits (Pharmacia). To determine Valpha and Vbeta sequences of this clone, a panel of Valpha and Vbeta subtype specific primers was synthesized and used in RT-PCR reactions with cDNA generated from each of the clones. The RT-PCR reactions demonstrated that each of the clones expressed a common Vbeta sequence that corresponded to the Vbeta8 subfamily and a Valpha sequence that corresponded to the Valpha8 subfamily. To clone the full TCR alpha and beta chains from clone 4H6, primers were designed that spanned the initiator and terminator-coding TCR nucleotides. The primers were as follows:
forward primer for TCR Valpha8 5' ggatccgccgccaccatgacatccattcgagctgta 3' (SEQ ID NO:435; has a BamHI site inserted);
Kozak reverse primer for TCR Valpha8 (antisense) 5' gtcgactcagctggaccacagccgcag 3' (SEQ ID NO:436; has a SalI site inserted plus the TCR alpha constant sequence);
forward primer for TCR Vbeta8 (sense) 5' ggatccgccgccaccatggactcctggaccttctgct 3' (SEQ ID NO:437; has a BamHI site inserted); and
Kozak reverse primer for TCR Vbeta 5' gtcgactcagaaatcctttctcttgac 3' (SEQ ID NO:438; has a SalI site inserted plus the TCR beta constant sequence).

Standard 35 cycle RT-PCR reactions were established using the cDNA synthesized from the CTL clone and the above primers utilizing the proofreading thermostable polymerase, PWO (Roche). The resultant PCR band, about 850 bp for Valpha and about 950 for Vbeta, was ligated into a PCR blunt vector (Invitrogen) and transformed into *E. coli*. *E. coli* transformed with plasmids having full-length alpha and beta chains were identified. Large scale preparations of the corresponding plasmids were generated, and these plasmids were sequenced. The Valpha sequence (SEQ ID NO:439) was shown by nucleotide sequence alignment to be homologous to Valpha8.1, while the Vbeta sequence (SEQ ID NO:440) was shown by nucleotide sequence alignment to be homologous to Vbeta8.2.

Example 22

Recombinant Expression of Full Length L762P in Mammalian Cells

Full length L762P cDNA was subcloned into the mammalian expression vectors VR1012 and pCEP4 (Invitrogen). Both expression vectors had previously been modified to contain a FLAG epitope tag. These constructs were transfected into HEK293 and CHL-1 cells (ATCC) using Lipofectamine 2000 reagent (Gibco). Briefly, both the HEK and CHL-1 cells were plated at a density of 100,000 cells/ml in DMEM (Gibco) containing 10% FBS (Hyclone) and grown overnight. The following day, 4 µl of Lipofectamine 2000 was added to 100 µl of DMEM containing no FBS and incubated for 5 minutes at room temperature. The Lipofectamine/DMEM mixture was then added to 1 µg of L762P Flag/pCEP4 or L762P Flag/VR1012 plasmid DNA resuspended in 100 µl DMEM and incubated for 15 minutes at room temperature. The Lipofectamine/DNA mix was then added to the HEK293 and CHL-1 cells and incubated for 48-72 hours at 37° C. with 7% CO$_2$. Cells were rinsed with PBS, then collected and pelleted by centrifugation. L672P expression was detected in the transfected HEK293 and CHL-1 cell lysates by Western blot analysis and was detected on the surface of transfected HEK cells by flow cytometry analysis.

For Western blot analysis, whole cell lysates were generated by incubating the cells in Triton-X100 containing lysis buffer for 30 minutes on ice. Lysates were then cleared by centrifugation at 10,000 rpm for 5 minutes at 4° C. Samples were diluted with SDS-PAGE loading buffer containing beta-mercaptoethanol, then boiled for 10 minutes prior to loading the SDS-PAGE gel. The protein was transferred to nitrocellulose and probed using 1 µg/ml purified anti-L762P rabbit polyclonal sera (lot #690/73) or non-diluted anti-L762P mAb 153.20.1 supernatant. Blots were revealed using either goat anti-rabbit Ig coupled to HRP or goat anti-mouse Ig coupled to HRP followed by incubation in ECL substrate.

For flow cytometric analysis, cells were washed further with ice cold staining buffer (PBS+1% BSA+Azide). Next, the cells were incubated for 30 minutes on ice with 10 ug/ml of purified anti-L762P polyclonal sera (lot #690/73) or a 1:2 dilution of anti-L762P mAb 153.20.1 supernatant. The cells were washed 3 times with staining buffer and then incubated with a 1:100 dilution of goat anti-rabbit Ig(H+L)-FITC or goat anti-mouse Ig(H+L)-FITC reagent (Southern Biotechnology) for 30 minutes on ice. After 3 washes, the cells were resuspended in staining buffer containing propidium iodide (PI), a vital stain that allows for the exclusion of permeable cells, and analyzed by flow cytometry.

Example 23

Generation of Polyclonal Antibodies to Lung Tumor Antigens

Three lung antigens, L523S (SEQ ID NO:176), L763P (SEQ ID NO:159) and L763 peptide #2684 (SEQ ID NO:441), were expressed and purified for use in antibody generation.

L523S and L763P were expressed in an *E. coli* recombinant expression system and grown overnight in LB Broth with the appropriate antibiotics at 37° C. in a shaking incubator. The next morning, 10 ml of the overnight culture was added to 500 ml of 2×YT with the appropriate antibiotics in a 2 L-baffled Erlenmeyer flask. When the optical density of the culture reached 0.4-0.6 at 560 nanometers, the cells were induced with IPTG (1 mM). Four hours after induction with IPTG, the cells were harvested by centrifugation.

The cells were then washed with phosphate buffered saline and centrifuged again. The supernatant was discarded and the cells were either frozen for future use or immediately processed. Twenty milliliters of lysis buffer was added to the cell pellets and vortexed. To break open the *E. coli* cells, this mixture was then run through a french press at a pressure of 16,000 psi. The cells were then centrifuged again and the supernatant and pellet were checked by SDS-PAGE for the partitioning of the recombinant protein.

For proteins that localized to the cell pellet, the pellet was resuspended in 10 mM Tris pH 8.0, 1% CHAPS and the inclusion body pellet was washed and centrifuged again. This procedure was repeated twice more. The washed inclusion body pellet was solubilized with either 8M urea or 6M guanidine HCl containing 10 mM Tris pH 8.0 plus 10 mM imidazole. The solubilized protein was added to 5 ml of nickel-chelate resin (Qiagen) and incubated for 45 minutes to 1 hour at room temperature with continuous agitation.

After incubation, the resin and protein mixture was poured through a disposable column and the flow through was collected. The column was then washed with 10-20 column volumes of the solubilization buffer. The antigen was then eluted from the column using 8M urea, 10 mM Tris pH 8.0 and 300 mM imidazole and collected in 3 ml fractions. A SDS-PAGE gel was run to determine which fractions to pool for further purification.

As a final purification step, a strong anion exchange resin, in this case Hi-Prep Q (Biorad), was equilibrated with the appropriate buffer and the pooled fractions from above were loaded onto the column. Each antigen was eluted off the column with an increasing salt gradient. Fractions were collected as the column was run and another SDS-PAGE gel was run to determine which fractions from the column to pool.

The pooled fractions were dialyzed against 10 mM Tris pH 8.0. The release criteria were purity as determined by SDS-PAGE or HPLC, concentration as determined by Lowry assay or Amino Acid Analysis, identity as determined by amino terminal protein sequence, and endotoxin level was determined by the *Limulus* (LAL) assay. The proteins were then put in vials after filtration through a 0.22-micron filter and the antigens were frozen until needed for immunization.

The L763 peptide #2684 was synthesized and conjugated to KLH and froze until needed for immunization.

The polyclonal antisera were generated using 400 micrograms of each lung antigen combined with 100 micrograms of muramyldipeptide (MDP). An equal volume of Incomplete Freund's Adjuvant (IFA) was added and then mixed and injected subcutaneously (S.C.) into a rabbit. After four weeks, the rabbit was S.C. boosted with 200 micrograms of antigen mixed with an equal volume of IFA. Thereafter the rabbit was I.V. boosted with 100 micrograms of antigen. The animal was bled seven days following each boost. The blood was then incubated at 4° C. for 12-24 hours followed by centrifugation to generate the sera.

The polyclonal antisera were characterized using 96 well plates coated with antigen and incubated with 50 microliters (typically 1 microgram/microliter) of the polyclonal antisera at 4° C. for 20 hours. Basically, 250 microliters of BSA blocking buffer was added to the wells and incubated at room temperature for 2 hours. Plates were washed 6 times with PBS/0.1% Tween. The rabbit sera were diluted in PBS/0.1% Tween/0.1% BSA. 50 microliters of diluted sera was added to each well and incubated at room temperature for 30 minutes. The plates were washed as described above, and then 50 microliters of goat anti-rabbit horseradish peroxidase (HRP) at a 1:10000 dilution was added and incubated at room temperature for 30 minutes.

The plates were washed as described above, and 100 microliters of TMB Microwell Peroxidase Substrate was added to each well. Following a 15-minute incubation in the dark at room temperature, the colorimetric reaction was stopped with 100 microliters of 1N $H_2SO_4$ and read immediately at 450 nm. All the polyclonal antibodies showed immunoreactivity to the appropriate antigen. Tables 7-9 show the antibody reactivity of rabbit antisera in serial dilution to the three lung antigens, L523S, L763P and L763 peptide #2684. The first column shows the antibody dilutions. The columns "Pre-immune sera" indicate ELISA data for two experiments using pre-immune sera. These results are averaged in the fourth column. The columns "anti-L523S, L763P or #2684" indicate ELISA data for two experiments using sera from rabbits immunized as described in this Example, using the respective antigen, referred to as either L523S, L763P or #2684 in the tables.

TABLE 7

| Antibody dilution | Pre-immune sera (1) | Pre-immune sera (2) | Average | Anti-L523S (1) | Anti-L523S (2) | Average |
|---|---|---|---|---|---|---|
| 1:1000 | 0.14 | 0.14 | 0.14 | 2.36 | 2.37 | 2.37 |
| 1:2000 | 0.12 | 0.10 | 0.11 | 2.29 | 2.23 | 2.26 |
| 1:4000 | 0.10 | 0.09 | 0.10 | 2.11 | 2.17 | 2.14 |

TABLE 7-continued

| Antibody dilution | Pre-immune sera (1) | Pre-immune sera (2) | Average | Anti-L523S (1) | Anti-L523S (2) | Average |
|---|---|---|---|---|---|---|
| 1:8000 | 0.09 | 0.09 | 0.09 | 1.98 | 2.00 | 1.99 |
| 1:16000 | 0.09 | 0.09 | 0.09 | 1.73 | 1.76 | 1.75 |
| 1:32000 | 0.09 | 0.09 | 0.09 | 1.35 | 1.40 | 1.37 |
| 1:64000 | 0.09 | 0.11 | 0.10 | 0.94 | 0.98 | 0.96 |
| 1:128000 | 0.09 | 0.08 | 0.08 | 0.61 | 0.61 | 0.61 |
| 1:256000 | 0.08 | 0.08 | 0.08 | 0.38 | 0.38 | 0.38 |
| 1:512000 | 0.09 | 0.08 | 0.08 | 0.24 | 0.25 | 0.25 |
| 1:1024000 | 0.08 | 0.08 | 0.08 | 0.17 | 0.17 | 0.17 |
| 1:2048000 | 0.08 | 0.08 | 0.08 | 0.14 | 0.13 | 0.13 |

TABLE 8

| Antibody dilution | Pre-immune sera (1) | Pre-immune sera (2) | Average | Anti-L763P (1) | Anti-L763P (2) | Average |
|---|---|---|---|---|---|---|
| 1:1000 | 0.09 | 0.11 | 0.10 | 1.97 | 1.90 | 1.93 |
| 1:2000 | 0.07 | 0.07 | 0.07 | 1.86 | 1.84 | 1.85 |
| 1:4000 | 0.06 | 0.06 | 0.06 | 1.82 | 1.81 | 1.81 |
| 1:8000 | 0.06 | 0.06 | 0.06 | 1.83 | 1.81 | 1.82 |
| 1:16000 | 0.06 | 0.05 | 0.06 | 1.79 | 1.74 | 1.76 |
| 1:32000 | 0.06 | 0.06 | 0.06 | 1.56 | 1.51 | 1.53 |
| 1:64000 | 0.06 | 0.05 | 0.05 | 1.35 | 1.34 | 1.35 |
| 1:128000 | 0.05 | 0.05 | 0.05 | 1.01 | 0.98 | 0.99 |
| 1:256000 | 0.06 | 0.05 | 0.05 | 0.69 | 0.70 | 0.70 |
| 1:512000 | 0.06 | 0.05 | 0.05 | 0.47 | 0.44 | 0.46 |
| 1:1024000 | 0.06 | 0.05 | 0.06 | 0.27 | 0.27 | 0.27 |
| 1:2048000 | 0.05 | 0.05 | 0.05 | 0.16 | 0.15 | 0.16 |

TABLE 9

| Antibody dilution | Pre-immune sera (1) | Pre-immune sera (2) | Average | Anti-#2684 (1) | Anti-#2684 (2) | Average |
|---|---|---|---|---|---|---|
| 1:1000 | 0.07 | 0.07 | 0.07 | 2.10 | 2.00 | 2.05 |
| 1:2000 | 0.07 | 0.06 | 0.06 | 1.95 | 1.96 | 1.95 |
| 1:4000 | 0.06 | 0.06 | 0.06 | 1.77 | 1.82 | 1.79 |
| 1:8000 | 0.06 | 0.06 | 0.06 | 1.79 | 1.81 | 1.80 |
| 1:16000 | 0.06 | 0.06 | 0.06 | 1.54 | 1.50 | 1.52 |
| 1:32000 | 0.06 | 0.06 | 0.06 | 1.27 | 1.20 | 1.24 |
| 1:64000 | 0.06 | 0.06 | 0.06 | 0.85 | 0.82 | 0.83 |
| 0 | 0.06 | 0.06 | 0.06 | 0.06 | 0.06 | 0.06 |

Tables 10-12 show the affinity purification of the respective antibodies to the three lung antigens, L523S, L763P and L763 peptide #2684.

TABLE 10

| Antibody conc. (µg/ml) | Affinity pure (salt peak) | Affinity pure (salt peak) | Average | Affinity pure (acid peak) | Affinity pure (acid peak) | Average |
|---|---|---|---|---|---|---|
| 1.0 | 2.38 | 2.35 | 2.36 | 2.25 | 2.31 | 2.28 |
| 0.5 | 2.24 | 2.22 | 2.23 | 2.19 | 2.18 | 2.18 |
| 0.25 | 2.05 | 2.09 | 2.07 | 2.01 | 2.03 | 2.02 |
| 0.13 | 1.70 | 1.81 | 1.75 | 1.74 | 1.74 | 1.74 |
| 0.063 | 1.44 | 1.44 | 1.44 | 1.43 | 1.38 | 1.40 |
| 0.031 | 1.05 | 1.05 | 1.05 | 0.99 | 0.99 | 0.99 |
| 0.016 | 0.68 | 0.67 | 0.68 | 0.65 | 0.64 | 0.64 |
| 0.0078 | 0.43 | 0.42 | 0.42 | 0.39 | 0.39 | 0.39 |
| 0.0039 | 0.27 | 0.26 | 0.27 | 0.24 | 0.26 | 0.25 |
| 0.0020 | 0.18 | 0.20 | 0.19 | 0.19 | 0.18 | 0.19 |
| 0.0010 | 0.13 | 0.14 | 0.13 | 0.13 | 0.14 | 0.13 |
| 0.00 | 0.11 | 0.12 | 0.11 | 0.10 | 0.12 | 0.11 |

TABLE 11

| Antibody dilution | Affinity pure | Affinity pure | Average |
|---|---|---|---|
| 1:1000 | 1.64 | 1.77 | 1.70 |
| 1:2000 | 1.59 | 1.76 | 1.68 |
| 1:4000 | 1.48 | 1.62 | 1.55 |
| 1:8000 | 1.35 | 1.43 | 1.39 |
| 1:16000 | 1.09 | 1.19 | 1.14 |
| 1:32000 | 0.81 | 0.89 | 0.85 |
| 1:64000 | 0.55 | 0.58 | 0.56 |
| 1:128000 | 0.31 | 0.35 | 0.33 |
| 1:256000 | 0.18 | 0.20 | 0.19 |
| 1:512000 | 0.11 | 0.12 | 0.11 |
| 1:1024000 | 0.07 | 0.07 | 0.07 |
| 1:2048000 | 0.06 | 0.06 | 0.06 |

TABLE 12

| Antibody conc. (µg/ml) | Affinity pure | Affinity pure | Average |
|---|---|---|---|
| 1.0 | 2.00 | 2.02 | 2.01 |
| 0.5 | 2.01 | 1.93 | 1.97 |
| 0.25 | 1.84 | 1.83 | 1.84 |
| 0.13 | 1.80 | 1.83 | 1.81 |
| 0.06 | 1.39 | 1.60 | 1.50 |
| 0.03 | 1.33 | 1.35 | 1.34 |
| 0.02 | 0.94 | 0.93 | 0.94 |
| 0.00 | 0.06 | 0.06 | 0.06 |

Example 24

Full-Length cDNA Sequence Encoding L529S

The isolation of a partial sequence (SEQ ID NO:106) for lung antigen L529S was previously provided in Example 2. This partial sequence was used as a query to identify potential full length cDNA and protein sequences by searching against publicly available databases. The predicted full-length cDNA sequence for the isolated cloned sequence of SEQ ID NO:106 is provided in SEQ ID NO:442. The deduced amino acid sequence of the antigen encoded by SEQ ID NO:442 is provided in SEQ ID NO:443. It was previously disclosed in Example 2 that L529S shows similarity to connexin 26, a gap junction protein.

Example 25

Expression in Megaterium of a Histidine Tag-Free L523S Fusion Protein

PCR was performed on the L523S coding region with the following primers:

Forward primer PDM-734 5' caatcaggcatgcacaacaaactg-tatatcggaaac 3' (SEQ ID NO:444) Tm 63° C.

Reverse primer PDM-735 5' cgtcaagatcttcattacttccgtct-tgac 3' (SEQ ID NO:445) Tm 60° C.

The PCR conditions were as follows:

10 µl 10×Pfu buffer 1.0 µl 10 mM dNTPs 2.0 µl 10 µM each primer

83 µl sterile water 1.5 µl Pfu DNA polymerase (Stratagene, La Jolla, Calif.)

50 ηg DNA

96° C. for 2 minutes, 96° C. for 20 seconds, 62° C. for 15 seconds, 72° C. for 4 minute with 40 cycles and then 72° C. for 4 minutes.

The PCR product was digested with SphI and BglII restriction enzymes, gel purified and then cloned into pMEG-3, which had been digested with SphI and BglII restriction enzymes. The correct construct was confirmed by DNA sequence analysis and then transformed into Megaterium cells for expression.

The amino acid sequence of expressed recombinant L523S is shown in SEQ ID NO:446, and the DNA coding region sequence is shown in SEQ ID NO:447.

Example 26

Expression in *E. Coli* of a Histidine Tag-Free L523S Fusion Protein

PCR was performed on the L523S coding region with the following primers:

Forward primer PDM-733 5' cgtactagcatatgaacaaactg-tatatcggaaac 3' (SEQ ID NO:448) Tm 64° C.
Reverse primer PDM-415 5' ccatagaattcattacttccgtct-tgactgagg 3' (SEQ ID NO:426) TM 62° C.

The PCR conditions were as follows:
10 µl 10×Pfu buffer
1.0 µl 10 mM dNTPs
2.0 µl 10 µM each primer
83 µl sterile water
1.5 µl Pfu DNA polymerase (Stratagene, La Jolla, Calif.)
50 ηg DNA
96° C. for 2 minutes, 96° C. for 20 seconds, 62° C. for 15 seconds, 72° C. for 4 minute with 40 cycles and then 72° C. for 4 minutes.

The PCR product was digested with NdeI and EcoRI restriction enzymes, gel purified and then cloned into pPDM, a modified pET28 vector, which had been digested with NdeI and EcoRI restriction enzymes. The correct construct was confirmed by DNA sequence analysis and then transformed into BLR pLys S and HMS 174 pLys S cells for expression.

The amino acid sequence of expressed recombinant L523S is shown in SEQ ID NO:449, and the DNA coding region sequence is shown in SEQ ID NO:450.

Example 27

Epitope-Analysis of L514S and L523S-Specific Antibodies

Peptides of candidate antigens can be used for the evaluation of antibody responses in both preclinical and clinical studies. These data allow one to further confirm the antibody response against a certain candidate antigen. Protein-based ELISA with and without competitive peptides and peptide-based ELISA can be used to evaluate these antibody responses. Peptide ELISA is especially useful since it can further exclude the false positive of the antibody titer observed in protein-based ELISA as well as to provide the simplest assay system to test antibody responses to candidate antigens. In this example, data was obtained using both L514S- and L523S-peptides that show that individual cancer patients produce L514S- and L523S-specific antibodies. The L514S-specific antibodies recognize primarily the following epitope of L514S:

aa86–110: LGKEVRDAKITPEAFEKLGFPAAKE (SEQ ID NO:451)

This epitope is the common epitope in humans. A rabbit antibody specific for L514S recognizes two addition epitopes of L514S:

(1) aa21–45: KASDGDYYTLAVPMGDVPMDGISVA (SEQ ID NO:452)

(2) aa121–135: PDRDVNLTHQLNPKVK (SEQ ID NO:453)

It was further found that the SEQ ID NO:452 is common to both L514S isoforms, L514S-13160 and L514S-13166, whereas the other epitopes, SEQ ID NO:451 and SEQ ID NO:453, are probably specific to the isoform, L514S-13160.

The L523S-specific antibodies recognize primarily the following epitope of L523S:

aa440–460: KIAPAEAPDAKVRMVIITGP (SEQ ID NO:454).

This epitope is the common epitope in humans. A rabbit antibody specific for L523S recognizes two other epitopes:

(1) aa156–175: PDGAAQQNNNPLQQPRG (SEQ ID NO:455)

(2) aa326–345: RTITVKGNVETCAKAEEEIM (SEQ ID NO:456)

In further studies, it was determined by peptide based ELISAs that eight additional epitopes of L523S were recognized by L523S-specific antibodies:

(1) aa40–59: AFVDCPDESWALKAIEALS (SEQ ID NO:457)

(2) aa80–99: IRKLQIRNIPPHLQWEVLDS (SEQ ID NO:458)

(3) aa160–179: AQQNPLQQPRGRRGLGQRGS (SEQ ID NO:459)

(4) aa180–199: DVHRKENAGAAEKSITILST (SEQ ID NO:460)

(5) aa320–339: LYNPERTITVKGNVETCAKA (SEQ ID NO:461)

(6) aa340–359: EEEIMKKIRESYENDIASMN (SEQ ID NO:462)

(7) aa370–389: LNALGLFPPTSGMPPPTSGP (SEQ ID NO:463)

(8) aa380–399: KIAPAEAPDAKVRMVIITGP (SEQ ID NO:466)

Out of these, six epitopes are common in both lung pleural effusion fluid samples and in sera of lung patients. Of these six, SEQ ID NO:459 and SEQ ID NO:463 have no homology to other L523S-family proteins such as IGF-II mRNA-binding proteins 1 and 2. Accordingly, this indicates that these two peptides can be used as an assay system to determine the antibody response to L523S.

Example 28

Generation of L523S-Specific CTL Lines Using In Vitro Whole-Gene Priming

To determine if L523S is capable of generating a CD8+ T cell immune response, CTLs were generated using in vitro whole-gene priming methodologies with tumor antigen-vaccinia infected DC (Yee et al, *The Journal of Immunology*, 157(9):4079-86, 1996), human CTL lines were derived that specifically recognize autologous fibroblasts transduced with the L523S tumor antigen, as determined by interferon-gamma ELISPOT analysis. Specifically, dendritic cells (DC) were differentiated from Percoll-purified monocytes derived from PBMC of normal human donors by plastic adherence and growing for five days in RPMI medium containing 10% human serum, 50 ng/ml human GM-CSF and 30 ng/ml human IL-4. Following the five days of culture, the DC were infected overnight with a recombinant adenovirus that expresses L523S at a multiplicity of infection (M.O.I) of 33, 66 and 100, and matured overnight by the addition of 2 μg/ml CD40 ligand. The virus was then inactivated by gamma irradiation. In order to generate a CTL line, autologous PBMC were isolated and CD8+ T cells were enriched for by the negative selection using magnetic beads conjugated to CD4+, CD14+, CD16+, CD19+, CD34+ and CD56+ cells. CD8+ T cells specific for L523S were established in round bottom 96-well plates using 10,000 L523S expressing DCs and 100,000 CD8+ T cells per well in RPMI supplemented with 10% human serum, 10 ng/ml of IL-6 and 5 ng/ml of IL-12. The cultures were restimulated every 7-10 days using autologous primary fibroblasts retrovirally transduced with L523S, and the costimulatory molecule CD80 in the presence of IL-2. The cells were also stimulated with IFN-gamma to upregulate MHC Class I. The media was supplemented with 10 U/ml of IL-2 at the time of stimulation as well as on days 2 and 5 following stimulation. Following three stimulation cycles, ten L523S specific CD8+ T cell lines were identified using interferon-gamma ELISPOT analysis that specifically produce interferon-gamma when stimulated with the L523S tumor antigen-transduced autologous fibroblasts, but not with a control antigen.

One line, 6B1, was cloned using anti-CD3 and feeder cells. The clones were tested for specificity on L523S-transduced fibroblasts. In addition, using a panel of HLA-mismatched lines transduced with a vector expressing L523S and measuring interferon-gamma production by this CTL line in an ELISPOT assay, it was determined that this clone 6B1.4B8 is restricted by HLA-A0201.

Also using transfected Cos cells, it was shown that clone 6B1.4B8 recognizes Cos cells transfected with pcDNA3 HLA A0201/L523S in an HLA-restricted and antigen specific manner.

An epitope mapping study demonstrated the clone 6B1.4B8 recognizes HLA-A201 LCL loaded with peptide pool 3 (a polypeptide corresponding to amino acid positions 33-59 of L523S.

A peptide pool breakdown study demonstrated that clone 6B1.4B8 recognizes autologous B-LCL loaded with 15-mer peptides from amino acid positions 37-55 of L523S, TGYAFVCPDESWALKAIE (SEQ ID NO:465). A further peptide breakdown study demonstrated that clone 6B1.4B8 recognizes T2 cells loaded with the same 15-mer peptides.

A peptide recognition study demonstrated that clone 6B1.4B8 prefers T2 cells loaded with the peptide FVDCPESWAL (SEQ ID NO:466) which is corresponds to the amino acid sequence at positions 41-51 of L523S and is encoded by the DNA sequence of SEQ ID NO:467.

Example 29

L523S Expression in Other Human Cancers

It was previously disclosed in Example 2 that L523S is expressed in lung cancers including squamous, adenocarcinoma and small cell carcinoma. To further evaluate the expression profile of this antigen an electronic express profiling was performed. This was done by searching a L523S-specific sequence against a public EST database. Results of this profiling indicate that L523S may also be present in colon adenocarcinomas, prostate adenocarcinomas, CML, AML, Burkitt's Lymphoma, brain tumors, retinoblastomas, ovarian tumors, teratocarcinomas, uterus myosarcomas, germ cell tumors as well as pancreatic and cervical tumor cell lines.

Example 30

Immunohistochemistry Analysis of L523S

In order to determine which tissues express the lung tumor antigen L523S, immunohistochemistry (IHC) analysis was performed on a diverse range of tissue types. Polyclonal antibodies specific for L523S (SEQ ID NO:176) were generated as described in Example 23. IHC was performed essentially as described in Example 6. Briefly, tissue samples were fixed in formalin solution for 12-24 hours and embedded in paraffin before being sliced into 8 micron sections. Steam heat induced epitope retrieval (SHIER) in 0.1 sodium citrate buffer (pH 6.0) was used for optimal staining conditions. Sections were incubated with 10% serum in PBS for 5 minutes. The primary L523S antibody was added to each section for 25 minutes followed by a 25 minute incubation with anti-rabbit biotinylated antibody. Endogenous peroxidase activity was blocked by three 1.5 minute incubations with hydrogen peroxidase. The avidin biotin complex/horse radish peroxidase (ABC/HRP) system was used along with DAB chromogen to visualize antigen expression. Slides were counterstained with hematoxylin to visualize the cell nuclei.

IHC analysis of L523S expression revealed that of the lung cancer tissues tested over 90% of tissue samples demonstrated high over-expression of the lung tumor antigen (10/11 adenocaricomas and 8/9 squamous). Of the normal tissues tested, all were negative for expression of L523S, with the exception of weak staining in normal bronchus, testis, liver, and trachea.

Example 31

Generation and Characterization of L762 Human Monoclonal Antibodies

Cell supernatants from hybridoma fusions from the Xenomouse strain of transgenic mice were screened for ability to bind to L762P. All results are shown in Table 13. The primary screen was to test monoclonal supernatants for reactivity to L762P by ELISA analysis using recombinant bacterial expressed protein. We next tested the human supernatants for reactivity to surface expressed L762P by whole cell ELISA using fluorimetry analysis. Specific reactivity of the humab supernatants was confirmed by performing FACS analysis on cells transfected with either an irrelevant plasmid or a plasmid expressing L762P. FI/CFI is the relative fold increase in fluorescence intensity (FI) of the anti-L762P humab primary antibody to irrelevant human primary antibody. FI/CFI/A20 is the relative fold increase in fluorescence intensity (FI) of the anti-L762P humab primary antibody to irrelevant human primary antibody over the FI of the anti-L762P mouse monoclonal antibody 153A20.1. FI/CFI/R690 is the relative fold increase in fluorescence intensity (FI) of the anti-L762P humab primary antibody to irrelevant human primary antibody over the FI of the anti-L762P rabbit polyclonal antibody. FACS VRL762 is the percentage of cells transfected with plasmid expressing L762P that were positive following staining with indicated monoclonal antibody. FACS VR(−) is the percentage of cells transfected with irrelevant plasmid that were positive following staining with indicated monoclonal antibody. ELISA is the O.D. values of the indicated monoclonal antibody to recombinant L762P protein. The shaded rows in Table 13 indicate those antibodies that will be further cloned and characterized.

TABLE 13

Human Monoclonal Antibodies Against L762P

| L762PHumAb | FI/CFI | FI/CFI/A20 | FI/CFI/R690 | FACSVRL762 | FACS VR(−) | ELISA | L762/VR1013 |
|---|---|---|---|---|---|---|---|
| R-690 | 4.59 | | 1.00 | | | | |
| M-A20 | 2.88 | 1.00 | | | | | |
| 1.176 | 0.51 | 0.18 | 0.11 | | | 0.38 | |
| 1.178 | 1.42 | 0.49 | 0.31 | | | 0.35 | |
| 1.179 | 0.47 | 0.16 | 0.10 | | | 0.07 | |
| 1.180 | 1.50 | 0.52 | 0.33 | | | 0.26 | |
| 1.182 | 1.45 | 0.50 | 0.32 | | | 0.26 | |
| 1.183 | 0.75 | 0.26 | 0.16 | | | 0.24 | |
| 1.185 | 0.89 | 0.31 | 0.19 | | | 0.46 | |
| 1.186 | 3.45 | 1.20 | 0.75 | 32.68 | 7.14 | 1.22 | 1.93 |
| 1.187 | 0.36 | 0.13 | 0.08 | | | 0.06 | |
| 1.188 | 0.26 | 0.09 | 0.06 | | | 0.23 | |
| 1.189 | 0.50 | 0.17 | 0.11 | | | 0.44 | |
| 1.190 | 0.53 | 0.18 | 0.12 | | | 0.42 | |
| 1.191 | 3.12 | 1.08 | 0.68 | 41.44 | 17.90 | 0.86 | 1.29 |
| 1.192 | 1.91 | 0.66 | 0.42 | | | 0.12 | |
| 1.193 | 2.87 | 1.00 | 0.63 | 17.82 | 6.43 | 0.13 | 1.06 |
| 1.194 | 1.55 | 0.54 | 0.34 | | | 0.28 | |
| 1.195 | 0.14 | 0.05 | 0.03 | | | 0.37 | |
| 1.196 | 1.97 | 0.68 | 0.43 | | | 0.89 | 1.64 |
| 1.197 | 0.43 | 0.15 | 0.09 | | | 0.08 | |
| 1.198 | 0.54 | 0.19 | 0.12 | | | 0.33 | |
| 1.199 | 0.70 | 0.24 | 0.15 | | | 0.40 | |
| 1.200 | 2.00 | 0.69 | 0.44 | | | 0.38 | 1.56 |
| 1.201 | 1.62 | 0.56 | 0.35 | | | 0.29 | |
| 1.202 | 0.86 | 0.30 | 0.19 | | | 0.36 | |
| 1.203 | 1.56 | 0.27 | 0.18 | | | 0.14 | |
| 1.204 | 3.32 | 0.58 | 0.38 | 24.83 | 6.60 | 0.17 | 1.91 |
| 1.205 | 2.13 | 0.37 | 0.25 | | | 0.09 | |
| 1.206 | 0.45 | 0.08 | 0.05 | | | 0.23 | |
| 1.207 | 0.60 | 0.10 | 0.07 | | | 0.39 | |
| 1.208 | 0.12 | 0.02 | 0.01 | | | 0.36 | |
| 1.209 | 15.52 | 2.71 | 1.80 | 27.54 | 9.54 | 0.16 | 0.77 |
| 1.210 | 0.92 | 0.16 | 0.11 | | | 0.16 | |
| 1.211 | 2.83 | 0.49 | 0.33 | | | 0.42 | |
| 1.212 | 3.40 | 0.59 | 0.39 | 21.68 | 11.36 | 0.14 | 2.47 |
| 1.213 | 2.32 | 0.40 | 0.27 | | | 0.38 | |
| 1.214 | 0.80 | 0.14 | 0.09 | | | 0.34 | |
| 1.215 | 3.96 | 0.69 | 0.46 | 38.87 | 13.17 | 0.33 | 1.80 |
| 1.216 | 1.26 | 0.22 | 0.15 | | | 0.20 | |
| 1.217 | 1.99 | 0.35 | 0.23 | | | 0.26 | |
| 1.218 | 2.29 | 0.40 | 0.27 | | | 0.10 | |
| 1.219 | 0.15 | 0.03 | 0.02 | | | 0.06 | |
| 1.220 | 0.82 | 0.14 | 0.09 | | | 0.21 | |
| 1.221 | 2.29 | 0.40 | 0.27 | | | 0.12 | |
| 1.222 | 0.57 | 0.10 | 0.07 | | | 0.45 | |
| 1.223 | 0.11 | 0.02 | 0.01 | | | 0.11 | |
| 1.224 | 2.08 | 0.36 | 0.24 | | | 0.25 | |
| 1.225 | 0.95 | 0.17 | 0.11 | | | 0.22 | |
| 1.226 | −0.32 | −0.06 | −0.04 | | | 0.06 | |
| R-690 | 8.62 | | 1.00 | 72.34 | 39.83 | | |
| M-A20 | 5.73 | 1.00 | | 50.23 | 6.34 | | |
| M-A12 | | | | 67.43 | 25.15 | | |
| M-Irr | | | | 7.74 | 7.35 | | |
| R-Irr | | | | 30.09 | 24.80 | | |
| H-Irr | | | | 25.52 | 39.14 | | |
| R-690 | 3.20 | | 1.00 | | | | |
| M-A20 | 2.33 | 1.00 | | | | | |
| 1.250 | 0.15 | 0.06 | 0.05 | | | 0.28 | |
| 1.228 | 0.38 | 0.16 | 0.12 | | | 0.08 | |
| 1.229 | 0.39 | 0.17 | 0.12 | | | 0.44 | |
| 1.230 | 1.78 | 0.76 | 0.56 | | | 0.13 | 0.135 |
| 1.231 | 0.42 | 0.18 | 0.13 | | | 0.47 | |
| 1.232 | 0.34 | 0.15 | 0.11 | | | 0.25 | |
| 1.233 | 7.07 | 3.04 | 2.21 | 68.84 | 38.60 | 0.43 | 0.75 |
| 1.234 | 2.54 | 1.09 | 0.79 | 33.96 | 10.94 | 0.73 | 1.68 |
| 1.235 | 1.53 | 0.65 | 0.48 | | | 0.19 | 1.45 |
| 1.236 | 0.17 | 0.07 | 0.05 | | | 0.44 | |

TABLE 13-continued

Human Monoclonal Antibodies Against L762P

| L762PHumAb | FI/CFI | FI/CFI/A20 | FI/CFI/R690 | FACSVRL762 | FACS VR(−) | ELISA | L762/VR1013 |
|---|---|---|---|---|---|---|---|
| 1.237 | 0.35 | 0.15 | 0.11 | | | 0.06 | |
| 1.238 | 0.38 | 0.16 | 0.12 | | | 0.06 | |
| 1.239 | 0.40 | 0.17 | 0.13 | | | 0.06 | |
| 1.240 | 2.05 | 0.88 | 0.64 | 28.70 | 7.44 | 0.33 | 1.70 |
| 1.241 | 0.41 | 0.18 | 0.13 | | | 0.41 | |
| 1.242 | 0.52 | 0.23 | 0.16 | | | 0.05 | |
| 1.243 | 2.34 | 1.00 | 0.73 | 30.94 | 28.13 | 0.16 | 1.33 |
| 1.244 | 0.94 | 0.40 | 0.29 | | | 0.23 | |
| 1.245 | 0.37 | 0.16 | 0.11 | | | 0.31 | |
| 1.246 | 2.10 | 0.90 | 0.66 | 13.97 | 28.92 | 0.52 | 1.21 |
| 1.247 | 0.33 | 0.14 | 0.10 | | | 0.37 | |
| 1.248 | 1.80 | 0.77 | 0.56 | | | 0.76 | |
| 1.249 | 2.77 | 1.19 | 0.86 | 28.76 | 12.37 | 1.15 | 2.38 |
| 1.251 | 0.22 | 0.09 | 0.07 | | | 0.47 | |
| 1.252 | 1.16 | 0.27 | 0.17 | | | 0.37 | |
| 1.253 | 0.07 | 0.02 | 0.01 | | | 0.43 | |
| 1.254 | 2.05 | 0.48 | 0.30 | | | 0.14 | |
| 1.255 | 0.09 | 0.02 | 0.01 | | | 0.08 | |
| 1.256 | 1.17 | 0.27 | 0.17 | | | 0.13 | |
| 1.257 | 0.42 | 0.10 | 0.06 | | | 0.06 | |
| 1.258 | 0.48 | 0.11 | 0.07 | | | 0.40 | |
| 1.259 | 4.82 | 1.13 | 0.69 | 40.24 | 11.92 | 0.38 | 1.78 |
| 1.260 | 1.80 | 0.42 | 0.26 | | | 0.38 | |
| 2.1 | 2.70 | 0.63 | 0.39 | | | 0.14 | 1.35 |
| 2.3 | 0.06 | 0.01 | 0.01 | | | 0.57 | |
| 2.4 | 3.08 | 0.72 | 0.44 | 31.28 | 11.43 | 0.73 | 1.95 |
| 2.5 | 0.70 | 0.16 | 0.10 | | | 0.45 | |
| 2.6 | 1.26 | 0.29 | 0.18 | | | 0.22 | |
| 2.8 | 0.59 | 0.14 | 0.09 | | | 0.31 | |
| 2.9 | 7.48 | 1.75 | 1.08 | 45.72 | 17.57 | 0.95 | 1.53 |
| 2.10 | 0.35 | 0.08 | 0.05 | | | 0.42 | |
| 2.11 | 2.71 | 0.63 | 0.39 | | | 0.60 | 1.58 |
| 2.12 | 6.04 | 1.41 | 0.87 | 52.50 | 19.59 | | 1.40 |
| 2.13 | 5.50 | 1.28 | 0.79 | 39.78 | 15.24 | | 1.39 |
| 2.14 | 0.68 | 0.16 | 0.10 | | | | |
| 2.15 | 6.51 | 1.52 | 0.94 | 49.90 | 15.36 | | 1.72 |
| 2.16 | 4.58 | 1.07 | 0.66 | 28.62 | 13.02 | | 1.51 |
| 2.17 | 8.10 | 1.89 | 1.17 | 48.76 | 18.24 | | 3.06 |
| R-690 | 6.94 | | 1.00 | | | | |
| M-A20 | 4.28 | 1.00 | | 56.40 | 5.00 | | |
| R-690 | 4.34 | 1.65 | 1.00 | | | | |
| M-A20 | 2.63 | 1.00 | 0.61 | | | | |
| 2.18 | 2.29 | 0.87 | 0.53 | | | 1.27 | 1.95 |
| 2.20 | 1.85 | 0.70 | 0.43 | | | 0.52 | 2.75 |
| 2.21 | 0.09 | 0.03 | 0.02 | | | 0.40 | |
| 2.22 | 3.26 | 1.24 | 0.75 | 29.4 | 6.2 | 1.45 | 1.8 |
| 2.23 | 0.31 | 0.12 | 0.07 | | | 0.12 | |
| 2.24 | 1.21 | 0.46 | 0.28 | | | 0.65 | |
| 2.25 | 3.47 | 1.32 | 0.80 | 32.5 | 7.1 | 1.35 | 1.46 |
| 2.26 | 4.42 | 1.68 | 1.02 | 35.9 | 5.5 | 0.77 | 1.55 |
| 2.27 | 1.42 | 0.54 | 0.33 | | | 0.22 | |
| 2.28 | 3.00 | 1.14 | 0.69 | 28.6 | 5.4 | 1.21 | 1.26 |
| 2.29 | 1.41 | 0.53 | 0.32 | | | 0.58 | |
| 2.30 | 0.42 | 0.16 | 0.10 | | | 0.43 | |
| 2.31 | 0.09 | 0.03 | 0.02 | | | 0.07 | |
| 2.34 | 1.94 | 0.74 | 0.45 | | | 1.17 | 1.23 |
| 2.38 | 1.14 | 0.43 | 0.26 | | | 0.09 | |
| 2.39 | 2.50 | 0.95 | 0.57 | 28.2 | 4.8 | 0.78 | 1.14 |
| 2.40 | 2.02 | 0.77 | 0.46 | | | 0.47 | 0.99 |
| 2.41 | 1.16 | 0.44 | 0.27 | | | 0.08 | |
| 2.42 | 0.41 | 0.16 | 0.09 | | | 0.24 | |
| 2.46 | 2.46 | 0.93 | 0.57 | 16.1 | 4.6 | 1.07 | 1.3 |
| 2.47 | 1.83 | 0.69 | 0.42 | | | 0.31 | 1.54 |
| 2.48 | 2.50 | 0.95 | 0.58 | | | 1.36 | 1.76 |
| 2.49 | 0.50 | 0.19 | 0.12 | | | 0.74 | |

TABLE 13-continued

Human Monoclonal Antibodies Against L762P

| L762PHumAb | FI/CFI | FI/CFI/A20 | FI/CFI/R690 | FACSVRL762 | FACS VR(−) | ELISA | L762/VR1013 |
|---|---|---|---|---|---|---|---|
| 2.50 | 2.93 | 1.11 | 0.68 | 15.8 | 4.7 | 0.52 | 1.54 |
| 2.51 | 0.13 | 0.10 | 0.07 | | | 0.30 | |
| 2.52 | 1.11 | 0.79 | 0.56 | 22.1 | 5 | 1.14 | 1.93 |
| 2.53 | 1.87 | 1.34 | 0.94 | 29.8 | 7.8 | 0.58 | 2.84 |
| 2.54 | 1.85 | 1.32 | 0.92 | 15.9 | 8.5 | 0.12 | 2.56 |
| 2.55 | 0.83 | 0.60 | 0.42 | | | 0.32 | |
| 2.58 | 0.46 | 0.33 | 0.23 | | | 0.15 | |
| 2.60 | 0.99 | 0.71 | 0.50 | | | 0.35 | |
| 2.61 | 2.16 | 1.54 | 1.08 | 30.7 | 7.9 | 1.34 | 2.88 |
| 2.62 | 0.36 | 0.26 | 0.18 | | | 0.58 | |
| 2.63 | 0.37 | 0.26 | 0.18 | | | 0.41 | |
| 2.64 | 1.60 | 1.14 | 0.80 | 25.7 | 6.1 | 1.39 | 2.85 |
| 2.65 | 0.63 | 0.45 | 0.31 | | | 0.16 | |
| 2.66 | 0.08 | 0.06 | 0.04 | | | 0.06 | |
| 2.67 | 1.34 | 0.96 | 0.67 | 23.3 | 4.5 | 1.32 | 1.34 |
| 2.68 | 0.66 | 0.47 | 0.33 | | | 0.38 | |
| 2.69 | 2.79 | 1.99 | 1.39 | 46.3 | 9.7 | 1.47 | 1.68 |
| 2.73 | 1.47 | 1.05 | 0.73 | 28.5 | 7.2 | 1.04 | 1.85 |
| 2.74 | 1.99 | 1.43 | 1.00 | 39.5 | 19.1 | 1.22 | 1.69 |
| 2.75 | 1.46 | 1.04 | 0.73 | 25.6 | 7.5 | 0.68 | 1.55 |
| 2.76 | 1.61 | 1.15 | 0.81 | 27.7 | 7.7 | 0.98 | 1.79 |
| 2.77 | 1.59 | 1.13 | 0.79 | 27.7 | 4.9 | 1.11 | 1.53 |
| 2.78 | 1.55 | 1.11 | 0.77 | 13.9 | 8 | 1.51 | 2.64 |
| 2.79 | 0.33 | 0.24 | 0.16 | 10 | 5.4 | 0.43 | |
| 2.80 | 1.47 | 1.05 | 0.73 | 15.9 | 8.8 | 0.46 | 0.95 |
| R-690 | 2.00 | 1.43 | 1.00 | | | | |
| M-A20 | 1.40 | 1.00 | | 56.4 | 5 | | |
| R-690 | 3.76 | 3.44 | 1.00 | | | | |
| M-A20 | 1.09 | 1.00 | | | | | |
| 2.81 | 0.25 | 0.23 | 0.07 | | | 0.17 | |
| 2.82 | 0.44 | 0.40 | 0.12 | | | 0.49 | |
| 2.83 | 0.63 | 0.58 | 0.17 | | | 0.80 | |
| 2.84 | 0.13 | 0.12 | 0.04 | | | 0.55 | |
| 2.85 | 0.62 | 0.57 | 0.16 | | | 0.19 | |
| 2.86 | 0.87 | 0.79 | 0.23 | | | 0.16 | |
| 2.87 | 0.84 | 0.77 | 0.22 | | | 0.22 | |
| 2.89 | 5.88 | 5.37 | 1.56 | 45.9 | 37.9 | 0.07 | 0.73 |
| 2.90 | 0.23 | 0.21 | 0.06 | | | 0.60 | |
| 2.91 | −0.37 | −0.34 | −0.10 | | | 0.43 | |
| 2.92 | 0.59 | 0.54 | 0.16 | | | 0.14 | |
| 2.93 | 0.28 | 0.26 | 0.08 | | | 0.44 | |
| 2.94 | 0.32 | 0.29 | 0.08 | | | 0.46 | |
| 2.95 | 0.39 | 0.36 | 0.10 | | | 0.51 | |
| 2.96 | 0.36 | 0.33 | 0.10 | | | 0.26 | |
| 2.97 | 1.26 | 1.15 | 0.33 | 36.8 | 14.1 | 1.01 | 0.89 |
| 2.98 | 0.92 | 0.84 | 0.24 | | | 0.84 | |
| 2.99 | 1.38 | 1.26 | 0.37 | 91.2 | 81.8 | 0.29 | |
| 2.100 | 0.94 | 0.86 | 0.25 | | | 1.40 | |
| 2.102 | 0.77 | 0.70 | 0.21 | | | 0.17 | |
| 2.104 | 1.37 | 1.25 | 0.36 | 10.2 | 7.4 | 0.14 | |
| 2.105 | 0.63 | 0.58 | 0.17 | | | 1.04 | |
| 2.106 | 0.79 | 0.72 | 0.21 | | | 0.84 | |
| 2.107 | 0.81 | 0.74 | 0.22 | | | 0.06 | |
| 2.109 | 0.66 | 1.24 | 0.32 | 19.2 | 6.1 | 0.45 | 0.89 |
| 2.110 | 1.58 | 3.00 | 0.77 | 36.4 | 14.2 | 0.89 | 1.11 |
| 2.112 | 0.80 | 1.52 | 0.39 | 28.8 | 6.4 | 1.16 | 1.35 |
| 2.113 | 0.57 | 1.07 | 0.27 | 31.4 | 10.7 | 0.66 | 1.17 |
| 2.114 | 0.52 | 0.99 | 0.25 | | | 0.32 | |
| 2.115 | 1.02 | 1.94 | 0.50 | 19.9 | 10.7 | 0.63 | 1.13 |
| 2.116 | 0.52 | 0.98 | 0.25 | | | 0.86 | |

TABLE 13-continued

Human Monoclonal Antibodies Against L762P

| L762PHumAb | FI/CFI | FI/CFI/A20 | FI/CFI/R690 | FACSVRL762 | FACS VR(−) | ELISA | L762/VR1013 |
|---|---|---|---|---|---|---|---|
| 2.118 | 0.19 | 0.36 | 0.09 | | | 0.06 | |
| 2.119 | 0.78 | 1.48 | 0.38 | 20.4 | 5.3 | 1.22 | 1.16 |
| 2.120 | 0.76 | 1.44 | 0.37 | 21.8 | 6 | 1.29 | 0.97 |
| 2.121 | 1.24 | 2.36 | 0.60 | 28.7 | 10.7 | 0.30 | 1.17 |
| 2.122 | 1.20 | 2.29 | 0.58 | 31.3 | 8.3 | 1.13 | 1.14 |
| 2.123 | 0.67 | 1.27 | 0.33 | 17.7 | 6.8 | 0.74 | 1.27 |
| R-690 | 2.06 | 3.91 | 1.00 | | | | |
| M-A20 | 0.53 | 1.00 | | 56.4 | 5 | | |
| R-690 | 3.51 | | 1.00 | | | | |
| M-A20 | 2.91 | 1.00 | | | | | |
| 1.1 | 1.05 | 0.36 | 0.30 | | | 0.16 | |
| 1.2 | −0.42 | −0.14 | −0.12 | | | 0.40 | |
| 1.3 | 1.04 | 0.36 | 0.30 | | | 1.31 | |
| 1.4 | 0.77 | 0.26 | 0.22 | | | 0.43 | |
| 1.5 | 0.19 | 0.06 | 0.05 | | | 0.13 | |
| 1.6 | 1.07 | 0.37 | 0.30 | | | 0.42 | |
| 1.7 | 0.09 | 0.03 | 0.03 | | | 0.33 | 0.80 |
| 1.8 | 2.93 | 1.01 | 0.83 | 54.70 | 45.60 | 0.59 | |
| 1.9 | 1.17 | 0.40 | 0.33 | | | 0.93 | |
| 1.10 | −0.04 | −0.02 | −0.01 | | | 0.08 | |
| 1.11 | −0.30 | −0.10 | −0.09 | | | 0.16 | |
| 1.12 | 0.11 | 0.04 | 0.03 | | | 0.25 | |
| 1.13 | 1.60 | 0.55 | 0.46 | | | 0.08 | |
| 1.14 | 0.69 | 0.24 | 0.20 | | | 0.13 | |
| 1.15 | 0.30 | 0.10 | 0.09 | | | 0.08 | |
| 1.16 | 1.44 | 0.49 | 0.41 | | | 0.08 | |
| 1.17 | −0.31 | −0.10 | −0.09 | | | 0.36 | |
| 1.18 | 0.05 | 0.02 | 0.01 | | | 0.17 | |
| 1.19 | −0.34 | −0.12 | −0.10 | | | 0.29 | |
| 1.20 | 0.84 | 0.29 | 0.24 | | | 0.45 | |
| 1.21 | −0.20 | −0.07 | −0.06 | | | 0.28 | |
| 1.22 | 0.14 | 0.05 | 0.04 | | | 0.06 | |
| 1.23 | 0.14 | 0.05 | 0.04 | | | 0.08 | |
| 1.24 | 1.02 | 0.35 | 0.29 | | | 0.16 | |
| 1.25 | 0.27 | 0.28 | 0.16 | | | 0.20 | |
| 1.26 | 1.06 | 1.09 | 0.62 | | | 0.31 | |
| 1.27 | 1.07 | 1.10 | 0.63 | | | 0.96 | |
| 1.28 | 2.14 | 2.21 | 1.26 | 3.60 | ND | 0.06 | 0.73 |
| 1.29 | 1.11 | 1.15 | 0.65 | | | 0.44 | 1.64 |
| 1.30 | 0.79 | 0.81 | 0.46 | | | 0.19 | |
| 1.31 | 1.42 | 1.46 | 0.84 | | | 0.23 | 1.27 |
| 1.32 | 1.37 | 1.42 | 0.81 | | | 0.11 | 1.91 |
| 1.33 | 0.29 | 0.30 | 0.17 | | | 0.18 | |
| 1.34 | 1.59 | 1.64 | 0.94 | 37.53 | 8.98 | 1.31 | 2.61 |
| 1.35 | 0.37 | 0.38 | 0.21 | | | 0.32 | |
| 1.36 | 0.70 | 0.72 | 0.41 | | | 0.17 | |
| 1.37 | 1.21 | 1.24 | 0.71 | | | 0.69 | |
| 1.38 | 0.63 | 0.65 | 0.37 | | | 0.38 | |
| 1.39 | 0.87 | 0.90 | 0.51 | | | 0.07 | |
| 1.40 | 0.71 | 0.73 | 0.42 | | | 0.26 | |
| 1.41 | 1.36 | 1.40 | 0.80 | 44.82 | 13.65 | 0.37 | 2.03 |
| 1.42 | 0.64 | 0.66 | 0.38 | | | 1.10 | |
| 1.43 | 0.46 | 0.47 | 0.27 | | | 0.09 | |
| 1.44 | 0.52 | 0.54 | 0.31 | | | 0.28 | |
| 1.45 | 0.74 | 0.76 | 0.44 | | | 0.15 | |
| 1.46 | 0.81 | 0.83 | 0.48 | | | 0.07 | |
| 1.47 | 0.46 | 0.47 | 0.27 | | | 0.24 | |
| 1.48 | 0.62 | 0.63 | 0.36 | | | 0.27 | |
| R-690 | 1.70 | | 1.00 | | | | |
| M-A20 | 0.97 | 1.00 | | | | | |
| R-690 | 1.84 | | 1.00 | | | | |
| M-A20 | 2.82 | 1.00 | | | | | |
| 1.49 | 0.76 | 0.27 | 0.41 | | | 0.14 | |
| 1.50 | −0.22 | −0.08 | −0.12 | | | 0.36 | |
| 1.51 | −0.35 | −0.12 | −0.19 | | | 0.45 | |
| 1.52 | 1.84 | 0.65 | 1.00 | 45.74 | 9.90 | 1.40 | 2.44 |
| 1.53 | 1.77 | 0.63 | 0.96 | 42.79 | 24.70 | 0.89 | |
| 1.54 | 1.08 | 0.38 | 0.59 | | | 0.80 | |

TABLE 13-continued

Human Monoclonal Antibodies Against L762P

| L762PHumAb | FI/CFI | FI/CFI/A20 | FI/CFI/R690 | FACSVRL762 | FACS VR(-) | ELISA | L762/VR1013 |
|---|---|---|---|---|---|---|---|
| 1.55 | 0.81 | 0.29 | 0.44 | | | 0.35 | |
| 1.56 | 1.26 | 0.45 | 0.69 | | | 0.30 | |
| 1.57 | 3.26 | 1.16 | 1.77 | 22.20 | ND | 1.31 | 2.69 |
| 1.58 | 0.81 | 0.29 | 0.44 | | | 0.80 | |
| 1.59 | 2.22 | 0.79 | 1.21 | 24.50 | ND | 1.28 | 2.40 |
| 1.60 | 0.55 | 0.19 | 0.30 | | | 0.23 | |
| 1.61 | 0.13 | 0.04 | 0.07 | | | 0.06 | |
| 1.62 | 0.75 | 0.27 | 0.41 | 24.89 | 10.23 | 0.25 | |
| 1.63 | 0.99 | 0.35 | 0.54 | | | 0.12 | |
| 1.64 | 3.60 | 1.28 | 1.96 | | | 0.06 | 0.88 |
| 1.65 | 0.32 | 0.11 | 0.18 | | | 0.29 | |
| 1.66 | 0.01 | 0.00 | 0.00 | | | 0.30 | |
| 1.67 | 2.00 | 0.71 | 1.09 | 9.30 | ND | 0.38 | |
| 1.68 | 0.86 | 0.30 | 0.47 | | | 0.21 | |
| 1.69 | 3.31 | 1.17 | 1.80 | 8.50 | ND | 0.22 | 2.39 |
| 1.70 | 3.66 | 1.30 | 1.99 | 24.96 | 12.00 | 0.84 | 2.08 |
| 1.71 | 2.01 | 0.71 | 1.09 | | | 0.21 | |
| 1.72 | 6.49 | 2.30 | 3.53 | 6.50 | ND | 0.21 | 1.89 |
| 1.73 | 19.95 | 0.28 | 0.21 | 3.20 | ND | 0.31 | |
| 1.74 | 19.33 | 0.27 | 0.21 | 5.50 | ND | 0.20 | |
| 1.75 | 22.25 | 0.31 | 0.24 | | | 0.10 | |
| 1.76 | 11.42 | 0.16 | 0.12 | | | 0.37 | |
| 1.77 | -15.90 | -0.23 | -0.17 | | | 0.08 | |
| 1.78 | -4.60 | -0.07 | -0.05 | | | 0.26 | |
| 1.79 | 18.78 | 0.27 | 0.20 | | | 0.25 | |
| 1.80 | 35.51 | 0.50 | 0.38 | 9.00 | ND | 0.71 | |
| 1.81 | -4.15 | -0.06 | -0.04 | | | 0.33 | |
| 1.82 | -37.51 | -0.53 | -0.40 | | | 0.17 | |
| 1.83 | 7.11 | 0.10 | 0.08 | | | 0.08 | |
| 1.84 | -21.33 | -0.30 | -0.23 | | | 0.06 | |
| 1.85 | -3.61 | -0.05 | -0.04 | | | 0.13 | |
| 1.86 | -19.68 | -0.28 | -0.21 | | | 0.06 | |
| 1.87 | -3.39 | -0.05 | -0.04 | | | 0.30 | |
| 1.88 | 55.61 | 0.79 | 0.59 | 5.50 | ND | 0.10 | 1.25 |
| 1.89 | -6.73 | -0.10 | -0.07 | | | 0.17 | |
| 1.90 | 11.18 | 0.16 | 0.12 | | | 0.10 | |
| 1.91 | -31.50 | -0.45 | -0.33 | | | 0.13 | |
| 1.92 | -7.56 | -0.11 | -0.08 | | | 0.13 | |
| 1.93 | -12.37 | -0.18 | -0.13 | | | 0.11 | |
| 1.94 | 49.60 | 0.70 | 0.53 | 14.10 | ND | 1.39 | 2.33 |
| 1.95 | 10.68 | 0.15 | 0.11 | | | 0.16 | |
| 1.96 | 144.63 | 2.05 | | 63.24 | 74.75 | 0.75 | 0.80 |
| R-690 | 94.09 | 1.33 | 1.00 | | | | |
| M-A20 | 70.64 | 1.00 | | | | | |
| R-690 | 7.59 | | 1.00 | | | | |
| M-A20 | 5.33 | 1.00 | | | | | |
| 1.97 | 1.47 | 0.28 | 0.19 | | | 0.37 | |
| 1.98 | 3.69 | 0.69 | 0.49 | 38.67 | 16.57 | 0.43 | 1.69 |
| 1.99 | 4.32 | 0.81 | 0.57 | 38.31 | 18.76 | 0.40 | 1.48 |
| 1.100 | 0.22 | 0.04 | 0.03 | | | 0.32 | |
| 1.101 | 2.06 | 0.39 | 0.27 | | | 0.49 | |
| 1.102 | 0.23 | 0.04 | 0.03 | | | 0.12 | |
| 1.103 | 0.33 | 0.06 | 0.04 | | | 0.28 | |
| 1.104 | 0.45 | 0.08 | 0.06 | | | 0.08 | |
| 1.105 | 4.19 | 0.79 | 0.55 | 37.19 | 12.41 | 0.25 | 2.18 |
| 1.106 | 4.22 | 0.79 | 0.56 | 46.24 | 30.59 | 1.21 | 1.58 |
| 1.107 | 0.15 | 0.03 | 0.02 | | | 0.06 | |
| 1.108 | 0.08 | 0.01 | 0.01 | | | 0.31 | |
| 1.109 | 2.70 | 0.51 | 0.36 | 6.5 | 6 | 0.07 | |
| 1.110 | 1.02 | 0.19 | 0.13 | | | 0.35 | |
| 1.111 | 2.55 | 0.48 | 0.34 | | | 0.10 | |
| 1.112 | 3.58 | 0.67 | 0.47 | 18.6 | 4.2 | 1.25 | 1.74 |
| 1.113 | 0.37 | 0.07 | 0.05 | | | 0.35 | |
| 1.114 | -0.06 | -0.01 | -0.01 | | | 0.27 | |
| 1.115 | 0.55 | 0.10 | 0.07 | | | 0.13 | |
| 1.116 | 2.24 | 0.42 | 0.30 | | | 0.44 | |
| 1.117 | 0.56 | 0.10 | 0.07 | | | 0.27 | |
| 1.118 | 0.77 | 0.14 | 0.10 | | | 0.43 | |
| 1.119 | 0.78 | 0.15 | 0.10 | | | 0.41 | |
| 1.120 | 0.73 | 0.14 | 0.10 | | | 0.58 | |

TABLE 13-continued

Human Monoclonal Antibodies Against L762P

| L762PHumAb | FI/CFI | FI/CFI/A20 | FI/CFI/R690 | FACSVRL762 | FACS VR(−) | ELISA | L762/VR1013 |
|---|---|---|---|---|---|---|---|
| 1.121 | 0.21 | 0.05 | 0.03 | | | 0.40 | |
| 1.122 | 0.11 | 0.03 | 0.02 | | | 0.29 | |
| 1.123 | 0.41 | 0.11 | 0.07 | | | 0.07 | |
| 1.124 | 3.66 | 0.95 | 0.61 | 41.27 | 34.83 | 0.28 | 1.85 |
| 1.125 | 2.67 | 0.69 | 0.44 | | | 0.27 | 1.55 |
| 1.126 | 2.36 | 0.61 | 0.39 | | | 0.86 | 1.71 |
| 1.127 | 0.70 | 0.18 | 0.12 | | | 0.11 | |
| 1.128 | 2.99 | 0.77 | 0.50 | | | 0.13 | 1.45 |
| 1.129 | 0.33 | 0.09 | 0.06 | | | 0.39 | |
| 1.130 | 0.40 | 0.10 | 0.07 | | | 0.18 | |
| 1.131 | 1.45 | 0.38 | 0.24 | | | 0.52 | |
| 1.132 | 0.33 | 0.08 | 0.05 | | | 0.25 | |
| 1.133 | 0.17 | 0.04 | 0.03 | | | 0.24 | |
| 1.134 | 0.86 | 0.22 | 0.14 | | | 0.15 | |
| 1.135 | 1.75 | 0.45 | 0.29 | | | 0.30 | |
| 1.136 | 1.35 | 0.35 | 0.23 | | | 0.07 | |
| 1.137 | 2.30 | 0.59 | 0.38 | | | 0.83 | 1.30 |
| 1.138 | 0.83 | 0.21 | 0.14 | | | 0.60 | |
| 1.139 | 1.57 | 0.41 | 0.26 | | | 0.55 | |
| 1.140 | 1.40 | 0.36 | 0.23 | | | 1.28 | |
| 1.142 | −0.10 | −0.03 | −0.02 | | | 0.26 | |
| 1.143 | 1.46 | 0.38 | 0.24 | | | 0.16 | |
| 1.144 | 2.41 | 0.62 | 0.40 | | | 0.76 | |
| R-690 | 6.00 | | 1.00 | | | | |
| M-A20 | 3.86 | 1.00 | | 56.4 | 5 | | |
| R-690 | 2.58 | 3.22 | 1.00 | | | | |
| M-A20 | 0.80 | 1.00 | | | | | |
| 1.145 | 0.23 | 0.29 | 0.09 | | | 0.18 | |
| 1.146 | −0.12 | −0.15 | −0.05 | | | 0.41 | |
| 1.147 | 0.14 | 0.18 | 0.06 | | | 0.31 | |
| 1.148 | 0.09 | 0.11 | 0.03 | | | 0.43 | |
| 1.149 | 0.39 | 0.49 | 0.15 | | | 0.37 | |
| 1.150 | 2.23 | 2.79 | 0.87 | 17.3 | 5.4 | 0.70 | 1.46 |
| 1.151 | 0.13 | 0.16 | 0.05 | | | 0.29 | |
| 1.152 | 0.55 | 0.69 | 0.21 | | | 0.33 | |
| 1.154 | −0.20 | −0.25 | −0.08 | | | 0.41 | |
| 1.155 | 0.16 | 0.19 | 0.06 | | | 0.23 | |
| 1.156 | 0.06 | 0.07 | 0.02 | | | 0.31 | |
| 1.158 | 0.54 | 0.67 | 0.21 | | | 0.58 | |
| 1.159 | 0.78 | 0.98 | 0.30 | | | 0.09 | |
| 1.160 | 0.23 | 0.29 | 0.09 | | | 0.08 | |
| 1.162 | 0.63 | 0.78 | 0.24 | | | 0.11 | |
| 1.163 | 0.20 | 0.25 | 0.08 | | | 0.10 | |
| 1.164 | 0.22 | 0.27 | 0.08 | | | 0.09 | |
| 1.166 | 1.41 | 1.76 | 0.55 | 22.9 | 5.3 | 0.52 | 2.41 |
| 1.167 | 0.32 | 0.40 | 0.12 | | | 0.08 | |
| 1.168 | 0.88 | 1.10 | 0.34 | 15.9 | 5.1 | 0.48 | 1.90 |
| 1.170 | 0.22 | 0.42 | 0.11 | | | 0.21 | |
| 1.171 | 0.40 | 0.76 | 0.19 | | | 0.38 | |
| 1.172 | 0.09 | 0.17 | 0.04 | | | 0.12 | |
| 1.174 | 0.23 | 0.43 | 0.11 | | | 0.15 | |
| 1.175 | 0.14 | 0.26 | 0.07 | | | 0.20 | |
| R-690 | 2.06 | 3.91 | 1.00 | | | | |
| M-A20 for 1.170 to 1.75 | 0.53 | 1.00 | | 56.4 | 5 | | |

FI-fluorescence intensity of primary antibody
CFI-fluorescence intensity of human irrelevant primary antibody.
A20-mouse anti-L762P monoclonal antibody
R690-rabbit anti-L762P affinity purified polyclonal antibody
FACS VRL762-percent positive cells from transient transfection of VR1013/L762 expression plasmid
FACS VR(−)-percent positive cells from transient transfection of empty VR1013 expression plasmid Example 32

Epitope Mapping and Purification of HL523S-Specific Antibodies

This Example describes the purification of L523S antibodies that can distinguish between human and mouse L523S homologs and will likely distinguish between hL523S and hL523S-family members such as hIMP-1 and hIMP-2.

L523S (full-length cDNA and amino acid sequence set forth in SEQ ID NO:347 and 348, respectively) is one of a family of proteins that includes hIMP-1 and hIMP-2. The members of this family of proteins have a high degree of similarity one to the other and are also highly similar between species. Thus, generating antibodies that specifically recognize human L523S (hL523S) and not other members of the protein family in humans or the mouse homologs, has been problematic. However, in order to evaluate preclinical and clinical L523S DNA/Adenoviral vaccines by detecting the protein expression of L523S, human L523S-specific antibodies are critical.

Polyclonal antibodies specific for hL523S were generated as described in Example 23. These antibodies were used to map epitopes. The epitope analysis showed 2 particular peptides of hL523S that were recognized, peptide 16/17 and peptide 32.

The amino acid sequences of both hL523S and mouse L523S (mL523S) peptide 16/17 and peptide 32 were then compared. Peptide 32/33 is identical between hL523S and mL523S. However, as the alignment below indicates, peptide 16/17 has 5 amino acid differences between the human and mouse homologs (underlined).

hL523S (16/∫) (SEQ ID NO:468): IPDEMAAQQNP LQQPRGRRGLGQR mL523S (16/∫) (SEQ ID NO:469): IPDETAAQQNPSPQ LRGRRGPGQR

Moreover, peptide-based ELISAs showed that peptide 17 is specifically recognized by lung cancer patient sera #197, and a homology search of peptide 17 between human IMP (hIMP) family members shows that there is little similarity in this region between family members. The hL523S peptide 17 (and 16/17) has less than 50% similarity to hL523S family members such as hIMP-1 and hIMP-2.

Based upon the epitope mapping of L523S-specific antibodies and the data from the homology search, hL523S or mL523S peptide 16/17-conjugated ligands were then used to purify human or mouse L523S-specific antibodies from rabbit polyclonal antibodies generated against hL523S protein as described in Example 23. The data from the antibodies purified by affinity chromatography using ligands conjugated with either hL523S-peptide 16/17 or mL523S-peptide 16/17 suggested that the affinity of antibodies specific to hL523S-peptide 16/17 is much higher than that of antibodies to mL523S-peptide 16/17 since they bind more strongly to hL523S-peptide 16/17 than to mL523S-peptide 16/17. The difference in affinity between the purified antibodies to human and mouse L523S-peptide 16/17 was confirmed by peptide-based ELISA. The antibodies purified by hL523S-peptide 16/17 selectively bind to human L523S-peptide 16/17 but bind much less or not at all to mL523S-peptide 16/17.

In order to further characterize the original polyclonal antibodies and antibodies purified by hL523S-peptide 16/17, immunoblot analysis was conducted using both human lung adenocarcinoma line as a source of hL523S protein and mouse whole body embryo (day 17 gestation) as the source of mL523S protein. This analysis showed that polyclonal antibodies specific for hL523S recognize hL523S protein expressed in the tumor cell line as well as mL523S protein expressed in whole body embryos of day 17 gestation. However, the addition of hL523S peptide 32/33 blocks binding of antibodies to human and mouse L523S proteins. Thus, the crossreactivity of the polyclonal antibodies to mL523S protein is due to the existence of antibodies specific to hL523S peptide 32/33. In marked contrast, the purified antibodies specific to hL523S peptide 16/17 do not bind mL523S protein expressed in mice embryos but do recognize hL523S protein expressed in human lung adenocarcinoma cells. These data confirm the ELISA data using hL523S-peptide 16/17 and mL523S-peptide 16/17 described above.

The amino acid sequence of hL523S peptide 16/17 used to purify the antibodies is about 60-70% similar to that of the mL523S-peptide 16/17 which is not recognized by hL523S-specific antibodies by Western blot analysis and peptide-based ELISA. The hL523S peptide 16/17 has less than 50% similarity to hL523S family members such as hIMP-1 and hIMP-2. Taken together, these data suggest that it is highly probable that the antibodies purified by hL523S peptide 16/17 described herein will also distinguish hL523S protein from the other hL523S family members.

In summary, antibodies purified with the hL523S peptide 16/17 do not recognize the mouse L523S homolog. The amino acid sequence of peptide 16/17 between hL523S family members is less similar than between human and mouse L523S. Thus, the hL523S-specific antibodies described above can be used to distinguish between human and mouse L523S and between members of the hL523S family of proteins and can therefore be used for the accurate detection of hL523S protein expression in animals and humans.

Example 33

In Vivo Immunogenecity of Lung Tumor Antigen L523

This example describes two in vivo immunogenicity studies to evaluate the vaccination of mice with either an adenovirus containing L523 or with L523 naked DNA followed by a second immunization with an adenovirus containing L523.

The first study involved the immunization of two strains of mice with L523 adenovirus. The C57Bl6 strain of mice is homozygous for HLA-type H-$2^b$, while strain B6D2(F1) is heterozygous for the HLA-type, H-$2^{b/d}$. Table 14 describes the initial immunization strategy employed.

TABLE 14

Immunization with L523 Adenovirus alone: Experimental Design

| Group | Immunization | Strain (4/group) |
| --- | --- | --- |
| 1 | $10^8$ PFU Ad L523 A | C57BL6 |
| 2 | $10^7$ PFU Ad hrGFP A | C57BL6 |
| 3 | $10^8$ PFU Ad L523 A | B6D2(F1) |
| 4 | $10^7$ PFU Ad hrGFP A | B6D2(F1) |
| 5 | Naïve | C57BL6 |
| 6 | Naïve | B6D2(F1) |

PFU = plaque forming unit;
GFP = green fluorescent protein;
Ad = adenovirus.

Mice were immunized intradermally with either $10^8$ PFU of L523-adenovirus or $10^7$ PFU of an irrelevant adenovirus (hrGFP). Three weeks following immunization, IgG1 and IgG2a antibody responses to L523 were examined in all groups of mice. Briefly, recombinant full length L523 (rL523) was coated onto ELISA plates and serum, at multiple dilutions, was added to the wells. Following a 60-minute incubation, the serum was washed from the wells and a secondary antibody, either specific for an IgG1 or IgG2a was added to the plates. Both antibodies were directly conjugated to horseradish peroxide (HRP). The levels of L523 antibodies, either IgG1 or IgG2a, were measured in all groups. In the C57BL6 mice, little to no L523-specific antibodies were detected following immunization. However, in the B6D2(F1) strain of mice immunized with L523 adenovirus, both IgG1 and IgG2a L523-specific antibodies were detected at serum dilution as low as 1/1000.

In addition to detecting L523-specific antibodies in the serum, interferon-gamma (IFN-γ) responses were assayed from immune spleen cells following in vitro stimulation with rL523 protein. Briefly, spleen cells were harvested from all mice groups and cultured for 3 days in 96-well plates. Culture conditions included, media alone, 1 or 10 µg/ml of rL523 protein, or 5 µg/ml of concanavalin A (Con A). After 3 days, the supernatants were harvested and assayed for IFN-γ levels in the supernatants.

Immunization with L523-adenovirus, but not an irrelevant adenovirus, elicited a strong IFN-γ response from the spleen cells which were stimulated with rL523. In general, responses were stronger in the B6D2(F1) mouse strain, as evidenced by both a higher level of IFN-γ production, as well as the fact that stimulation with a lower antigen concentration (1 µg/ml) elicited an equally strong response as seen with the higher antigen concentration (10 µg/ml).

Finally, T cell proliferation responses were assayed from immune spleen cells by stimulation in vitro with rL523 protein. Briefly, spleen cells were cultured for 4 days in 96-well plates with, media alone, 1 or 10 µg/ml of rL523 protein, or Con A. The cultures were then pulsed with 3H-thymidine for the final 8 hours of culture. Results are represented as the stimulation index (SI) in the presence of antigen relative to stimulation with media alone. Results were consistent with those obtained in the IFN-γ assay. Immunization with L523-adenovirus, but not an irrelevant adenovirus, elicited a proliferation response in spleen cells stimulated with rL523. A strong SI (average of >20) was observed in spleen cells harvested from the B6D2(F1) mouse strain, with similar levels of proliferation observed at both protein concentrations. Little or no T cell proliferation was observed in the C57BL6 mouse strain.

A second study involved the immunization of two strains of mice initially with L523 naked DNA followed by a second immunization with L523 adenovirus two weeks later. The mice were harvested 3 weeks after the boost. Table 15 describes the immunization regimen of the second study.

TABLE 15

Immunization with L523 DNA followed by a second immunization with L523-Adenovirus: Experimental Design

| Group | Immunization | Strain (4/group) |
| --- | --- | --- |
| 1 | L523 DNA + $10^8$ PFU Ad L523 A | C57BL6 |
| 2 | $10^8$ PFU Ad L523 A | C57BL6 |
| 3 | Irrelevant DNA + $10^7$ PFU Ad hrGFP A | C57BL6 |
| 4 | $10^7$ PFU Ad hrGFP A | C57BL6 |
| 5 | Naïve | C57BL6 |
| 6 | L523 DNA + $10^8$ PFU Ad L523 A | B6D2(F1) |
| 7 | $10^8$ PFU Ad L523 A | B6D2(F1) |
| 8 | Irrelevant DNA + $10^7$ PFU Ad hrGFP A | B6D2(F1) |
| 9 | $10^7$ PFU Ad hrGFP A | B6D2(F1) |
| 10 | Naïve | B6D2(F1) |

PFU = plaque forming unit;
GFP = green fluorescent protein;
Ad = adenovirus.

As described in the first study, strong IgG1 and IgG2a antibody responses were observed in B6D2(F1) mice following immunization with L523-adenovirus Immunizing with L523 DNA appeared to increase the overall L523-specific antibody response compared to responses achieved with immunization with L523-adenovirus alone. C57BL6 mice elicited little or no L523-specific antibody responses following immunization with L523-adenovirus, but were some slightly positive responses were detected in mice immunized with L523 DNA followed by a second immunization with L523-adenovirus.

IFN-γ responses were assayed from immune spleen cells by stimulation in vitro with rL523 protein. These results confirm those observed in the initial study demonstrating the immunogenecity of L523 in animals. The results also suggest that initially immunizing the animals with L523 DNA, prior to immunization with L523-adeonvirus, does not significantly increase the CD4 response. As with the initial study, responses appear to be stronger in the B6D2(F1) strain of mice than the C57BL6 strain.

As with the initial study, T cell proliferation responses were assayed from immune spleen cells by stimulation in vitro with rL523 protein. The results from using two rounds of immunization are consistent with those obtained from the first study. Immunization with L523 DNA prior to a second round of immunization with L523-adenovirus did not significantly increase the proliferation responses generated in the mice. As with the first study, responses were stronger in the B6D2(F1) mouse strain than in the C57BL6 strain.

The difference in HLA types between the two strains of mice could explain variations in the extent of the immune responses detected. As described above, the C57BL6 strain is homozygous for $H-2^b$, while the B6D2(F1) is heterozygous for $H-2^{b/d}$. The increased diversity of the B6D2(F1) strains HLA type allows for a greater number of epitopes derived from the L523 protein to be presented. In this strain, epitopes specific for both $H-2^b$ and $H-2^d$ can be presented, while only $H-2^b$ epitopes can be presented by the C57BL6 strain.

Example 34

Generation of Mouse Monoclonal Antibodies to L523S Recombinant Protein

This example describes the generation of mouse monoclonal antibodies specific for the lung tumor antigen, L523S. These data show that L523S is immunogenic and support its use to generate B cell immune responses in vivo. Further, the antibodies generated herein can be used in diagnostic and passive immunotherapeutic applications.

Production and purification of proteins used for antibody generation: *E. coli* expressing recombinant L523S protein were grown overnight in LB Broth with the appropriate antibiotics at 37° C. in a shaking incubator. The next morning, 10 ml of the overnight culture was added to 500 ml of 2×YT plus appropriate antibiotics in a 2L-baffled Erlenmeyer flask. When the optical density (at 560 nanometers) of the culture reached 0.4-0.6, the cells were induced with IPTG (1 mM). Four hours after induction with IPTG the cells were harvested by centrifugation. The cells were then washed with phosphate buffered saline and centrifuged again. The supernatant was discarded and the cells were either frozen for future use or immediately processed. Twenty milliliters of lysis buffer was added to the cell pellets and vortexed. To lyse the *E. coli* cells, this mixture was then run through the French Press at a pressure of 16,000 psi. The cells were then centrifuged again and the supernatant and pellet were checked by SDS-PAGE for the partitioning of the recombinant protein. For proteins that localized to the cell pellet, the pellet was resuspended in 10 mM Tris pH 8.0, 1% CHAPS and the inclusion body pellet was washed and centrifuged again. This procedure was repeated twice more.

The washed inclusion body pellet was solubilized with either 8 M urea or 6 M guanidine HCl containing 10 mM Tris pH 8.0 plus 10 mM imidazole. The solubilized protein was added to 5 ml of nickel-chelate resin (Qiagen) and incubated for 45 min to 1 hour at room temperature with continuous agitation. After incubation, the resin and protein mixture were poured through a disposable column and the flow through was collected. The column was then washed with 10-20 column volumes of the solubilization buffer. The antigen was then eluted from the column using 8M urea, 10 mM Tris pH 8.0 and 300 mM imidazole and collected in 3 ml fractions. A SDS-PAGE gel was run to determine which fractions to pool for further purification. As a final purification step, a strong anion exchange resin such as Hi-Prep Q (Biorad) was equilibrated with the appropriate buffer and the pooled fractions from above were loaded onto the column. Each antigen was eluted off of the column with an increasing salt gradient. Fractions were collected as the column was run and another SDS-PAGE gel was run to determine which fractions from the column to pool. The pooled fractions were dialyzed against 10 mM Tris pH 8.0. This material was then submitted to Quality Control for final release. The release criteria were purity as determined by SDS-PAGE or HPLC, concentration as determined by Lowry assay or Amino Acid Analysis, identity as determined by amino terminal protein sequence, and endotoxin level was determined by the *Limulus* (LAL) assay. The protein was then vialed after filtration through a 0.22-micron filter and the antigens were frozen until needed for immunization.

To generate anti-L523S mouse monoclonal antibodies, mice were immunized IP with 50 micrograms of recombinant L523S protein that had been mixed to form an emulsion with an equal volume of Complete Freund's Adjuvant (CFA). Every three weeks animals were injected IP with 50 micrograms of recombinant L523S protein that had been mixed with an equal volume of IFA to form an emulsion. After the fourth injection, spleens were isolated and standard hybridoma fusion procedures were used to generate anti-L523S mouse monoclonal antibodies.

Anti-L523S monoclonal antibodies were screened by ELISA analysis using the bacterially expressed recombinant L523S protein as follows. 96 well plates were coated with antigen by incubating with 50 microliters (typically 1 microgram) at 4° C. for 20 hours. 250 microliters of BSA blocking buffer was added to the wells and incubated at RT for 2 hours. Plates were washed 6 times with PBS/0.01% tween. Fifty microliters of each undiluted monoclonal supernatant were added per well and incubated at room temperature for 30 minutes. Plates were washed as described above before 50 microliters of goat anti-mouse horse radish peroxidase (HRP) at a 1:10000 dilution was added and incubated at RT for 30 minutes. Plates were washed as described above and 100 µl of TMB Microwell Peroxidase Substrate was added to each well. Following a 15 minutes incubation in the dark at room temperature the colorimetric reaction was stopped with 100 µl 1N H2SO4 and read immediately at 450 nm. A list of the mouse anti-L523S monoclonal antibodies that were generated, as well as their reactivity in an ELISA assay and Western blot are shown in Table 16. For Western blot analysis, recombinant L523S protein was diluted with SDS-PAGE loading buffer containing beta-mercaptoethanol, then boiled for 10 minutes prior to loading the SDS-PAGE gel. Protein was transferred to nitrocellulose and probed with each of the anti-L523S hybridoma supernatants. Anti-mouse-HRP was used to visualize the anti-L523S reactive bands by incubation in ECL substrate.

TABLE 16

ELISA and Western Blot Analysis of L523S Monoclonal Antibodies

| L523S Mouse Monoclonal Supernatant | ELISA | | Western Blot HPP14 | |
|---|---|---|---|---|
| | L523S | Irrelevant | (Irrelevant | L523S |
| 213C3 | + | + | ND | ND |
| 213C49 | + | + | ND | ND |
| 213C62 | + | + | ND | ND |
| 213C69 | + | − | − | + |
| 213C80 | + | − | − | + |

ND: not determined

The data described in the above example show that L523S is immunogenic and can be used to generate B cell immune responses in vivo. Further, the antibodies generated herein have utility in diagnostic and passive immunotherapeutic applications.

Example 35

L523S-Specific T Cells and Identification of L523S T Cell Epitopes

This example describes the identification of specific epitopes recognized by L523S antigen-specific T cells. These experiments further confirm the immunogenicity of the L523S protein and support its use as a target for vaccine and/or other immunotherapeutic approaches.

A pool of 20-mer peptides, overlapping by 10 amino acids, that span the entire amino acid sequence of L523S (full length amino acid sequence of L523S provided in SEQ ID NO:176) was used in in vitro culture with T cells derived from normal donor PBMC to expand CD4 and CD8 T cells. Cultures were established from multiple donors and T cell responses were monitored following successive in vitro stimulations. L523S-specific T cell responses were detected in 4 of 4 normal donors. Given that a number of tumor antigens are identified for each tumor type that are reasonable vaccine candidates, this methodology can be used to compare the antigen-specific T cell frequency of different antigens.

T cell lines were generated from normal donor PBMCs. The source of T cells was from the CD69 negative population of PBMCs that had been precultured for 1-2 days. Several different priming conditions were evaluated to identify the most efficient method. These conditions are summarized in Table 17. In all assays, the T cells were initially primed with one of the conditions described in Table 17, plus IL-12 for 2-3 days. Il-2 and IL-7 were then added to the cultures which were further cultured for one week. The cultures were then restimulated 2 or 3 times with PBMCs pulsed with the entire pool of overlapping L523S peptides. The cells were collected following the last restimulation and analyzed for antigen-specificity using an IFN-γ solubilized ELISPOT assay. As shown in Table 17, priming cultures with peptide pulsed dendritic cells (DCs) was the most effective for generating antigen-specific T cell lines, either in 96 well or 24 well plates.

TABLE 17

Conditions used to prime donor T cells
with L523S overlapping peptides

| Condition: | |
|---|---|
| A | Peptide-pulsed PMBCs/irradiated (overnight pulse, irradiated 11 minutes) |
| B | Peptide-pulsed DCs/irradiated (overnight pulse, irradiated 11 minutes) |
| C | Peptide-pulsed PBMCs/fixed (overnight pulse, 30 second PFA fix) |
| D | Peptide-pulsed PBMCs/mitomycin C-treated 30 minutes (overnight pulse) |

| | Condition (type of plate) | | | Assay (solubilized | |
|---|---|---|---|---|---|
| Experiment: | Prime | Stimulation 1 | Stimulation 2–3 | ELISPOT) Target Cells | T cell response |
| I | A (96U) | A (96U) | A (24F) | D (96U) | + |
| II | B (96U) | A (96U) | A (24F) | D (96U) | +++ |
| III | C (96U) | C (96U) | C (96U) | C (96U) | − |
| IV | B (24F) | A (24F) | A (24F) | D (96U) | +++ |

Abreviations:
96U: 96 well, U-bottomed plates;
24F: 24 well, flat-bottomed plates.

Further analysis of the T cell lines generated as described above showed that these lines generally recognized target cells pulsed with whole protein antigen as well as peptides, demonstrating that at least some of the epitopes identified are naturally processed. Additional analysis using anti-MHC Class I and Class II antibodies showed that, while some of the T cell response was MHC class I restricted (CD8+ T cell-mediated), most of the T cell response generated using this method was MHC class II restricted, and thus mediated by CD4+ T cells.

Following the generation of the T cell lines using a pool of overlapping peptides spanning the entire L523S molecule, target cells pulsed with pools of fewer peptides breaking the L523S into smaller regions were then used to further map the epitopes recognized by the line generated from 4 different donors. Table 18 summarizes the epitope mapping analysis using different conditions described in Table 17. The amino acid sequences of those pools of overlapping peptides that included an epitope (pools 1-6, 14-19, 20-25, 26-30.5, 31-36, 37-40.5, 41-46.5, and 47-53) are provided in SEQ ID NO:470-477. Minimal epitope mapping using T cells from an additional donor, D366, demonstrated that peptide #4 (SEQ ID NO:470) was recognized in this donor.

In an additional study, donor D446 was further evaluated for T cell responses against 2 other lung-specific antigens in addition to L523S. T cell lines were generated and epitopes identified from donor D446 using overlapping peptides for all three lung-specific antigens. This experiment demonstrated that a single donor can have T cell responses to multiple antigens, including L523S. In a related study, 3 different donors were analyzed for their T cell response to the same lung-specific antigen. All three donors recognized different epitopes of this antigen. Therefore, these data support the use of multiple epitopes from multiple lung tumor antigens, including L523S, in vaccine strategies for lung cancers.

In summary, a peptide pool of overlapping 20-mer peptides spanning the entire L523S protein were used to generate T cell lines and to map T cell epitopes recognized by these lines. Most, but not all, the T cell lines also recognized whole protein pulsed target cells suggesting that at least some of the epitopes are naturally processed. Furthermore, the responses to targets pulsed with pooled or individual peptides were equal or higher than those to target cells pulsed with whole protein showing that this technique is more sensitive for detecting immune responses. Moreover, this technique can be used for all individuals, regardless of their HLA type. An additional advantage of this approach to evaluating T cell responses to lung-specific antigens is responses to *E. coli* and viral antigens is avoided. Given that a number of tumor antigens can be identified for a given tumor type that are attractive vaccine candidates, this methodology can be used to compare the antigen-specific T cell frequency of different antigens.

The experiments described above further confirm the immunogenicicty of the L523S lung tumor antigen and support its use as a target for vaccine and other immunotherapeutic approaches. Further, the above experiments identify specific epitopes of the L523S protein that may be of particular importance in the development of such approaches.

Example 36

Viral-Mediated Delivery of L523S In Vivo

This example describes the generation of an illustrative adenovirus vector expressing the L523S lung tumor antigen. This vector was used in in vivo immunogenicity studies, such as those described in Examples 33 and 37. This and

TABLE 18

Summary of L523S epitope analysis

| Peptide Pool Donor-Condition: | 1–6 | 7–13 | 14–19 | 20–25 | 26–30.5 | 31–36 | 37–40.5 | 41–46.5 | 47–53 |
|---|---|---|---|---|---|---|---|---|---|
| D223-IV | | | | | + | | | | |
| D223-I | | | | + | + | | | | + |
| D366-II | + | | | | | + | + | + | |
| D366-I | | | | | | | | + | |
| D446-II | | | | | + | + | + | | |
| D446-I | | | + | | + | | | | |
| D35 | | | | | | + | | | | other viral vectors have utility in DNA-based vaccination and/or immunotherapeutic strategies for L523S-associated cancers.

A replication defective E1 and E3 deleted human adenovirus serotype 5 vector expressing human L523S under the control of the CMV promoter was generated using standard molecular biology techniques. The cDNA sequence of the Adenovirus-L523S vector is set forth in SEQ ID NO:479. The cDNA sequence encoding the full-length L523S protein is set forth in SEQ ID NO:478 with the corresponding amino acid sequence set forth in SEQ ID NO:480. Infection of human cells with this construct was shown by immunoblot analysis to lead to high level expression of the L523S protein.

The antigenic nature of the adenoviral proteins introduced into and produced in the host cell during the course of infection act to increase immune surveillance and recognition of L523S as an immunological target. Thus, this adenoviral vector expressing high levels of the L523S tumor antigen has particular utility in inducing therapeutic or curative immune responses against endogenous tumor cells expressing L523S in lung cancer patients.

Example 37

In Vivo Immunogenecity of Lung Tumor Antigen L523S

This Example further validates the use of L523S DNA and L523S adenovirus prime/boost regimens in generating in vivo immune responses to this lung tumor antigen in vivo. Further, murine CD4 and CD8 T cell epitopes of human L523S are described herein. The results described herein provide support for the use of L523S DNA and adenovirus prime/boost regimen as a vaccine strategy for treating L523S-associated cancers.

The results demonstrated that the vaccination strategy of immunization with L523S DNA followed by boosting with L523S adenovirus elicits strong CD4 and CD8 T cell responses as well as antibody responses. These results further showed that C57Bl/6 mice elicit a predominately strong CD8 T cell response, whereas B6D2F1 mice elicit a predominately strong CD4 and antibody response to L523S. The CD8 T cell epitope was identified as being contained in the region corresponding to amino acids 9-27 (LSENAAPSDLESIFKDAKI; set forth in SEQ ID NO:481) of the L523S protein. The epitope was fine mapped to the minimal 9-mer, AAPSDLESI, set forth in SEQ ID NO:491. The CD4 epitope(s) were identified as being contained in the region corresponding to amino acids 33-75 (FLVKTGYAFVDCPDESWALKAIEALSGKIELHGKPIEVEHSVP; set forth in SEQ ID NO:482) of the L523S protein. Minimal epitopes required for T cell recognition of both the CD4 and CD8 epitopes are currently being identified.

This study involved the immunization of two strains of mice initially with L523S naked DNA followed by a second immunization with L523S adenovirus (see Example 36) two weeks later essentially as described in Example 33. The mice were harvested at day 35 post boost. Table 19 describes the immunization regimen of the second study.

TABLE 19

Immunization with L523 DNA Followed by a Second Immunization with L523-Adenovirus: Experimental Design

| Group | Prime (d0) | Boost (d14) | Strain (8/group) |
|---|---|---|---|
| 1 | 100 ug L523S DNA*, i.m. | $10^8$ PFU Ad L523 A, i.d | B6 |
| 2 | 100 ug L523S DNA, i.m. | $10^8$ PFU Ad L523 A, i.d | (B6D2) F1 |
| 3 | Naïve | | (B6D2) F1 and B6 |

PFU = plaque forming unit;
Ad = adenovirus.
*L523S was cloned into the pVAX vector (Invitrogen, Carlsbad, CA) using standard techniques.

Multiple CD8 and CD4 T cell assays were used to determine the in vivo immunogenicity of L523S DNA/adenovirus prime boost strategy and to identify the specific epitopes being recognized.

CD8 T Cell Assays:

Pools of overlapping 15-mer peptides spanning the entire L523S protein were used to directly stimulate spleen cells. IFNγ producing cells were analyzed by IFNγ ELISPOT following a 48 hour stimulation. This experiment showed that strong CD8 T cells specific for L523S peptides 3 and 4 within pool 1, corresponding to amino acids 9-27 of the L523S protein (LSENAAPSDLESIFKDAKI; set forth in SEQ ID NO:481) were present in L523S immunized C57bl/6 mice, but not in immunized B6D2F1 mice. The epitope was fine mapped to the minimal 9-mer, MPSDLESI, set forth in SEQ ID NO:491. Spleen cells stimulated for 6 hours with pools of overlapping peptides were analyzed using intracellular cytokine (IFNγ) staining. Results confirmed that strong CD8 T cell responses were generated in C57bl/6 mice to L523S peptide pool 1 but that no responses to these L523S peptides were observed in immunized B6D2F1 mice. Percentages of peptide specific IFNγ producing CD8 positive T cells in immunized C57bl/6 mice ranged from 0.17 to 2.86 (media alone controls ranged from 0.02-0.08; naïve controls for peptide pool 1 were at 0.06; irrelevant peptide controls ranged from 0.04-0.07). Chromium release assays were then carried out using spleen cells stimulated for 6 days with L523S transduced tumor cells as effector cells and peptide-pulsed tumor cells (F45) or tumor cells (EL-4 or RMA) transduced with L523S as targets. Results confirmed that the CD8 T cells specific for L523S peptides present in immunized C57bl/6 mice are functionally lytic. Again, no lytic T cell responses were detected against these L523S peptides in B6D2F1 mice.

CD4 T Cell Assays:

Direct IFNγ ELISPOT assays as described above showed that moderate responses were detected in B6D2F1 mice. CD4 T cells specific for L523S peptides within pools 3-4, corresponding to amino acids 33-75 of the L523S protein FLVKTGYAFVDCPDESWALKAIEALSGK-IELHGKPIEVEHSVP; set forth in SEQ ID NO:482) are present in L523 immunized B6D2F1 mice. No responses were detected in immunized C57bl/6 mice to these peptides. Intracellular cytokine staining confirmed that IFNγ producing CD4 T cells are present in L523S immunized B6D2F1 mice. Percentages of peptide specific IFNγ producing CD4 positive T cells in immunized B6D2F1 mice ranged from 0.29 to 0.5 (media alone controls ranged from 0.01-0.05; naïve controls for peptide pool 3/4 were at 0.03; irrelevant peptide controls ranged from 0.03-0.08). T cell proliferation and IFNγ production were detected in both C57bl/6 and B6D2F1 mice following 3 days in vitro stimulation with L523S protein or peptides as shown by standard proliferation and ELISA assays. Peptide pools showing reactivity were the same peptides that were detected by IFNγ ELISPOT and intracellular staining assays.

Anti-L523S Antibody Responses:

IgG1 and IgG2a antibody responses to L523S were examined in all groups of mice essentially as described in Example 33. B6D2F1 mice make strong anti-L523S antibody responses following L523S DNA/adenovirus immunization, with the IgG2a response being stronger than the IgG1 response. Consistent with previous results, C57Bl/6 mice make little to no anti-L523S antibody response following L523S DNA/adenovirus immunization.

In summary, the results described above further validate the use of L523S DNA and adenovirus prime/boost regimen as a vaccine strategy. The mouse models described above provide systems for determining the efficacy of DNA/adenovirus L523S immunization strategies and the respective roles of CD4, CD8, and antibody responses in therapeutic and curative immunity to L523S-expressing tumors. Further, the above experiments further confirm that L523S is immungenic in vivo and thus has utility as a target for vaccine and other immunotherapeutic strategies.

Example 38

Isolation of a Primate Homologue of L523S

This example describes the isolation of the full-length cDNA and protein sequence of the rhesus macaque (*Macaca mulatta*) homologue of the L523S lung tumor antigen. The purpose of this experiment was to identify an animal model for the validation of L523S vaccine strategies.

Four pairs of PCR primers were designed to anneal to conserved regions of the L523S cDNA by comparing mouse and human L523S sequences. A rhesus monkey placenta library was generated using standard techniques and the library cDNA was used as template in a standard PCR reaction. Four overlapping amplicons that span the entire L523S cDNA were obtained and sequenced (cDNA set forth in SEQ ID NO:483; amino acid sequence set forth in SEQ ID NO:484). The L523S primate homologue has 99% sequence identity to human L523S at the cDNA and amino acid level. Thus, this experiment shows that the rhesus macaque provides an animal model in which to validate L523S vaccine strategies.

Example 39

Expression of Full-Length L523S in Insect Cells Using a Baculovirus Expression System This example describes the expression in insect cells of full-length lung cancer antigen L523S, together with a C-terminal 10× His Tag, using a Baculovirus expression system. The recombinant protein has utility in the development of cancer vaccine, antibody therapeutics and diagnostics for cancers associated with L523S expression.

Full-length L523S cDNA, together with its Kozak consensus sequence and a C-terminal 10× His Tag (cDNA set forth in SEQ ID NO:485, amino acid sequence set forth in SEQ ID NO:486), was made by PCR from plasmid PCEP4-L523S, with primers L523F1 (SEQ ID NO:487) and L523RV1, (SEQ ID NO:488). The purified PCR product was cloned into the EcoR I site of the donor plasmid pFastBac1. The recombinant donor plasmid, pFBL523, was transformed into *E. coli* strain DH10Bac (Invitrogen, Carlsbad, Calif.) to make recombinant bacmid in *E. coli* through site-specific transposition. The recombinant bacmid DNA was confirmed by PCR analysis, and then transfected into Sf-9 insect cells to make recombinant baculovirus BVL523. The recombinant virus was amplified to high titer viral stock in Sf-9 cells.

The High Five insect cell line was used to optimize conditions for the protein expression and for the large-scale production of the recombinant protein. For the large-scale protein expression, High 5 insect cells were infected by the recombinant baculovirus at an MOI of 1.0 for 48 hours before harvesting. The identity of the protein was confirmed by Western blot with an affinity-purified rabbit polyclonal antibody against L523S, and by mass spectrometry analysis by Capillary LC-ESI-MSMS. For Mass-spectrometry analysis, a Capillary column was filled with C18 resin (100 mm i.d., 12 cm long). Peptides were concentrated on the column and eluted by a gradient of 5 to 65% B over 20 min (A: 0.2% acetic acid in water; B: 80% acetonitrile in A). Eluted peptides were introduced into the ion Trap mass spectrometry (Finnigan, Calif.) by electrospray ionization via an electrospray ionization interface (Cytopeia, Seattle, Wash.) and analyzed by data dependent MS and tandem MS (MS/MS) scans. The collision induced dissociation spectra (tandem mass spectra, MS/MS) generated during the experiment were searched against human protein and L523S protein database using Sequest software to identify possible sequence matches. Using Sequest search, 13 peptides from L523S were identified, confirming expression of the L523S protein.

Example 40

Regression of L523S-Expressing Murine Tumors Following Vaccination with L523S DNA and Adenovirus This Example shows that T cells specific for L523S are capable of mediating tumor regression in vivo. Therefore, the data described herein further validate the use of L523S DNA and L523S adenovirus prime/boost regimens in generating in vivo immune responses to this lung tumor antigen and provide support for the use of L523S DNA and adenovirus prime/boost regimen as a vaccine strategy for treating L523S-associated cancers.

The experiments described below demonstrate in vivo efficacy of L523S vaccination in a tumor protection model. The data demonstrate that vaccination with a combination of VR1012-L523S plasmid DNA (VR1012, see: Hum Gene Ther 1996 Jun. 20;7(10):1205-17, Vical Incorporated, 9373 Towne Centre Drive, San Diego, Calif.), and recombinant L523S adenovirus (see Example 36) in a prime/boost format can prevent the progression of L523S-expressing tumor cells in mice. The results show a statistical difference in the rate and size of tumors in L523S-vaccinated mice compared to control, naïve mice.

C57Bl/6 mice (12/group) were immunized as outlined in Table 20. DNA immunizations were administered intramuscularly in the anterior tibialis muscle and adenovirus immunizations were administered intradermally at the base of the tail. On day 28, 7 naïve mice and 8 mice in each of the remaining groups were challenged subcutaneously with $3.0 \times 10^5$ EL4-L523S stably transduced tumor cells. Tumor growth was monitored every 3-4 days over the course of the next 3 weeks. The mean tumor size (mm) for each group was measured at each time point. Prior to the final tumor measurement at 21 days post tumor challenge (day 21), four animals were sacrificed because their tumors were so large. For these animals, the missing tumor measurement at day 21 was estimated using the previous (day 18) tumor measurement. In addition, 4 mice/group were harvested on day 35 for immunologic analysis.

TABLE 20

Immunization with L523S DNA followed by a second immunization with L523S-Adenovirus: Experimental Design

| Group | Primary Immunization Day 0 | Boost Day 14 |
|---|---|---|
| 1: L523S DNA/L523S Adenovirus | 100 ug pVAX-L523S | $10^8$ pfu Adenovirus L523S |
| 2: L523S DNA | 100 ug pVAX-L523S | — |
| 3: L523S Adenovirus | — | $10^8$ pfu Adenovirus L523S |
| 4: Naïve | — | — |

Mean tumor size results for Day 15, Day 18, and Day 20 measurements are summarized in Tables 21, 22, and 23. Table 24 shows the 95% confidence limits for the difference between mean tumor measurements on day 20 (experimental group minus naïve group). The results showed that the development of tumor in all of the groups including both immunized and naïve mice appeared to be quite similar until day 10. At that time, the tumor growth in the immunized mice remained constant or regressed slightly whereas the growth of the tumor in naïve mice continued to progress rapidly. In order to confirm that these observations were significant, a statistical analysis was performed as follows. A repeated measures analysis of variance (ANOVA) model, including terms for treatment group, animal within treatment group and time (day post challenge) was used to analyze the tumor measurement data. If the treatment group X time interaction was statistically significant, separate ANOVAs were done for each treatment group and for each time. At each time point, each experimental group (Adeno+DNA, Adeno Alone, DNA Alone) was compared to the control group (Naïve) using Dunnett's t-tests. A 0.05 level of significance was used for all analyses.

The statistical analysis showed that there was a significant ($p<0.0001$) interaction between treatment group and time. Therefore, at each time point an ANOVA was performed to compare the treatment groups in terms of mean tumor size. The treatment groups were not significantly different at either day 7 ($p=0.287$) or day 11 post challenge ($p=0.570$). However, there were significant differences among the treatment groups at the remaining time points (Tables 21-23). The results of this analysis clearly indicate a statistically significant difference in tumor growth between the immunized animals and the naïve animals particularly at the latest time point (day 20).

TABLE 21

Day 15 Tumor Measurements

| Group | N | Mean | Standard Deviation |
|---|---|---|---|
| Adeno + DNA | 8 | 57.4 | 25.74* |
| Adeno alone | 8 | 49.04 | 27.99* |
| DNA Alone | 8 | 67.49 | 20.10 |
| Naïve | 7 | 100.24 | 37.21 |

*Significantly different from naïve group at 0.05 level.

TABLE 22

Day 18 Tumor Measurements

| Group | N | Mean | Standard Deviation |
|---|---|---|---|
| Adeno + DNA | 8 | 59.69 | 50.58 |
| Adeno alone | 8 | 39.37 | 36.46* |
| DNA Alone | 8 | 64.18 | 36.95 |
| Naïve | 7 | 121.3 | 66.9 |

*Significantly different from naïve group at 0.05 level.

TABLE 23

Day 20 Tumor Measurements

| Group | N | Mean | Standard Deviation |
|---|---|---|---|
| Adeno + DNA | 8 | 63.57 | 56.87* |
| Adeno alone | 8 | 56.48 | 59.94* |
| DNA Alone | 8 | 66.3 | 46.79* |
| Naïve | 7 | 140.25 | 53.53 |

*Significantly different from naïve group at 0.05 level.

TABLE 24

95% Confidence Limits for Day 20 Tumor Measurements

| Comparison | Difference Between means | 95% Confidence Limits |
|---|---|---|
| DNA Alone – Naïve | −73.95 | (−143.96, −3.93)* |
| Adeno + DNA – Naïve | −76.68 | (−146.7, −6.67)* |
| Adeno Alone – Naïve | −83.77 | (−153.79, −13.76)* |

*Comparison significant at 0.05 level.

In conclusion, the data clearly indicate that T cells specific for L523S are capable of recognizing and lysing L523S-expressing tumor cell lines in vitro (see Example 37) and that such T cells are capable of mediating tumor regression in vivo. Therefore, these data provide support for the use of L523S DNA and adenovirus prime/boost regimen as a vaccine strategy for treating L523S-associated cancers.

Example 41

Generation of L514S-Specific Cytotoxic T Lymphocytes (CTL) by In Vitro Priming and Identification of a CTL Epitope This example describes the generation of L514S-specific CD8+ T lymphocytes from a normal donor and identification of an L514S CTL epitope. L514S is a lung tumor antigen that is preferentially expressed in non small cell lung carcinomas. These experiments further confirm the immunogenicity of the L514S protein and support its use as a target for vaccine and/or other immunotherapeutic approaches. Further, this experiment identifies an illustrative T cell epitope that can be used in vaccine and immunotherapeutic strategies.

Autologous dendritic cells were differentiated from Percoll-purified monocytes using GM-CSF (50 ng/ml) and IL-4 (30 ng/ml). Following 5 days of culture, the dendritic cells were infected with recombinant L514S-adenovirus at an MOI of 20. After infection, the DC were matured with the addition of 2 ug/ml CD40L (trimer). CD8+ cells were enriched for by the depletion of CD4 and CD14-positive cells. Priming cultures were initiated in individual wells of six 96-well plates with IL-6 and IL-12. These cultures were restimulated in the presence of IL-2 using autologous fibroblasts treated with IFN-γ and transduced with L514S and CD80. Following 3 restimulation cycles, the presence of L514S-specific CTL activity was assessed in IFN-γ ELISPOT assays using as APC IFN-γ treated autologous fibroblasts transduced to express either L514S or the irrelevant antigen L552S. Of approximately 576 lines, 8 lines were identified that appeared to specifically recognize L514S. Lines 2-4A, 3-12E, and 5-3C were cloned using anti-CD3 and feeder cells. The clones were tested for specificity on L514S-transduced fibroblasts. In the antibody blocking assay, the fibroblasts transduced with L514S were pre-treated for 30 minutes with the antibody blockers and the final concentration was 50 ug/mL once the T cells were added. In the HLA-mismatch assay, the panel of DCs was infected with either adenovirus L514 or a control adenovirus at an MOI of 10. This infection went for 48 hours before they were assayed by ELISPOT assay.

To generate CTL, autologous dendritic cells were infected with a recombinant adenovirus that expresses L514S. Purified CD8 T cells were stimulated by these infected DCs and then restimulated weekly using autologous fibroblasts expressing L514S and the costimulatory molecule CD80 in the presence of IL-2. Eight microcultures were identified that specifically recognize target cells expressing L514S but not control antigen using ELISPOT analysis. All 8 lines were restimulated and confirmed by ELISPOT to be specific for L514S. At the same time, three of the lines were cloned. These lines are referred to as 2-4A, 3-12E, and 5-3C. L514S-specific clones were obtained from all three lines. 50 specific clones were obtained from Line 2-4A, 11 specific clones were obtained from line 3-12E, and 17 specific clones were obtained from line 5-3C.

Clones from each line were tested in an antibody blocking assay to determine their HLA restriction. All of the clones tested appear to be HLA-B/C restricted. Additional experiments using a panel of adenovirus-L514S and adenovirus control infected DCs that matched at certain HLA alleles showed that these clones are restricted by HLA*B4403.

In order to map the epitopes being recognized by these clones, clone 6 from line 2-4A and clone 1 from line 3-12E were further tested against autologous PBMC pulsed with 20-mer L514S peptides overlapping by 15 amino acids that span the entire L514S protein. Both clones recognize peptide 28. To fine map the minimal epitope, smaller peptides from peptide 28 were made and the 10-mer minimal epitope was identified as peptide 10 (set forth in SEQ ID NO:490; the cDNA encoding this epitope is set forth in SEQ ID NO:489).

In conclusion, these data confirm the immunogenicity of L514S as a T cell antigen as well as its suitability as a component of a lung cancer vaccine. Further, the above experiments identify a specific epitope of the L514S protein that may be of particular importance in the development of such vaccines.

Example 42

Identification of Antibodies Recognizing Tumor Associated Antigen NY-ESO-1 Peptide Specific Antigenic Epitopes in Biological Samples from Patients with Lung Cancer This example describes the detection of antibodies specific for the lung tumor antigen, NY-ESO-1 in patient serum and lung pleural effusion fluid using a peptide-array assay. Further, specific epitopes recognized by these patient antibodies were identified. These data validate the use of this peptide-array assay in diagnostic applications.

The peptide-array screening method described in further detail below was used to characterize a patient's antibodies against one or more TA-antigens based on antibody specificity, sensitivity (intensity) and clonality. This method was validated by specifically detecting the presence of antibodies recognizing the tumor-associated antigen (TA-antigen) referred to as NY-ESO-1 (Proc Natl Acad Sci USA 1997 Mar. 4;94(5):1914-8) in lung cancer patient serum and pleural effusion fluid samples.

In a first study, using Western transfer and immunoblot analysis, serum and lung pleural effusion fluid samples were evaluated for the presence of antibodies recognizing recombinant NY-ESO-1. Briefly, samples from patient numbers 205, 208 and 12 were screened by Western transfer and immunoblot analysis using recombinant NY-ESO-1 protein prepared from an *E. coli* host cell expression system. The patient serum samples contained antibodies that clearly recognized recombinant NY-ESO-1 6× his-tagged fusion protein (approximately 20 kDa in size), however, the presence of antibodies recognizing a number of *E. coli* host cell proteins contained in this preparation of recombinant NY-ESO-1 were also detected.

In order to further characterize a patient's NY-ESO-1 specific antibodies, a series of overlapping peptides 20 amino acids in length, corresponding to the entire sequence of NY-ESO-1, were synthesized and dispensed (displayed) into individual wells of a multiwell plate. Sera or lung pleural effusion samples were then added to each well containing an NY-ESO-1 peptide, negative control wells included buffer alone or peptides unrelated to TA-antigen NY-ESO-1. An ELISA was used to detect signal corresponding to the presence of specific antibodies recognizing one or more NY-ESO-1 antigenic epitopes. In this study, the serum sample obtained from patient sample 205 was shown to contain antibodies capable of detecting an NY-ESO-1 antigenic epitope contained in peptide number 2, corresponding to amino acid sequence STGDADGPGGPGIPDGPGGN (SEQ ID NO:492); antibodies contained in patient sample number 208 detected peptide number 3, corresponding to amino acid sequence PGIPDGPGGNAGGPGEAGAT (SEQ ID NO:493), peptide number 10, corresponding to amino acid sequence YLAMPFATPMEAELARRSLA (SEQ ID NO:494), peptide number 5, corresponding to amino acid sequence GGRGPRGAGAARASGPGGGA (SEQ ID NO:496) and lower levels of peptide number 2; patient sample number 12 recognized peptides 2 and 10; patient sample number 57 recognized peptide numbers 2, 5, 10, and 17 corresponding to amino acid sequence WITQCFLPVFLAQPPSGQRR (SEQ ID NO:495).

Since a number of peptide specific epitopes may be detected by a sample obtained from a single patient, the peptide-array method disclosed herein is also used to evaluate the clonality of a patient's antibody repertoire recognizing a particular TA-antigen. For example, patient sample 205 appears to be monoclonal in its recognition profile, while patient sample numbers 12 and 208 appear to be polyclonal in their recognition pattern. The clonality of a patient's antibody repertoire may be used to monitor or otherwise further characterize a patient's specific immune response and to evaluate the implications for the progression of a cancer, such as a lung cancer, in a patient.

In further experiments, Western transfer and immunoblot analysis was used to confirm that a patient's antibodies recognizing a NY-ESO-1 peptide epitope could also detect full-length recombinant NY-ESO-1. The data from these experiments clearly indicate that patient sample numbers 205 and 12 also detect a full-length recombinant NY-ESO-1 protein. The NY-ESO-1 signal so detected was shown to be specific, as it was competed away when immunoblots were probed with patient sample 205 plus peptide 2, or when patient sample 12 was used in the presence of peptides 2 and 10. Non-specific signal was not competed away in the presence of any NY-ESO-1 peptide.

Peptides detected according to this procedure were used to search the GenBank protein database for homology with other proteins. Such a search indicate that NY-ESO-1 peptides 2 and 3 are 100% homologous, peptides 5 and 17 are 95% homologous, and peptide 10 is 60% homologous to LAGE-1a, a member of the NY-ESO-1 protein family.

In conclusion, the data described in this example validate the peptide-array assay by specifically detecting antibodies specific for NY-ESO-1 in lung cancer patients. Further, specific epitopes recognized by these patient antibodies were described. The disclosed peptide-array screening method has been shown to eliminate detection of non-specific antibodies that may be present in a biological sample derived from a patient, thereby ensuring a high degree of sensitivity and specificity. Peptide-array screening may be used to evaluate the clonality of a patient's antibody repertoire recognizing one or more TA-antigens, and may be useful in a variety of diagnostic, prognostic and/or therapeutic methods for lung cancer. Further, the specific epitopes described herein can also be used in diagnostic, prognostic and/or therapeutic methods for lung cancer.

Example 43

Identification of Patient Antibodies Recognizing Specific Antigenic Peptide Epitopes of the Lung Tumor Associated Antigen L523S This example describes the detection of antibodies specific for the lung tumor antigen, L523S, in lung cancer patient serum and lung pleural effusion fluid. Further, specific epitopes recognized by these patient antibodies were identified. Additionally, patient antibodies were shown to crossreact with proteins in the IMP family related to L523S. These data confirm that L523S is immunogenic and support its use to generate B cell immune responses in vivo. Further, specific peptide epitopes that can be used in such approaches were identified. Additionally, the peptide-array assay described herein can be used in diagnostic applications for L523S alone or in combination with other lung tumor antigens.

The lung tumor-associated antigen identified in Example 2 as L523S (SEQ ID NO:175) was shown to be overexpressed in lung cancer tissues including squamous, adenocarcinoma and small cell carcinoma. Recombinant 6× his-tagged L523S polypeptide (SEQ ID NO:427) was expressed, purified and used in an ELISA to evaluate serum samples obtained from patients with lung cancer for the presence of antibodies recognizing a full-length L523S polypeptide. The ELISA results indicate that serum samples from patient numbers 27, 55, 66, and 67 possess antibodies capable of recognizing recombinant L523S. The same patient serum samples were also used in Western transfer (immunoblot) analysis of recombinant L523S 6× his-tagged fusion protein. The serum samples evaluated were shown to contain specific antibodies capable of detecting recombinant full-length L523S (approximately 70 kDa) but also contained non-specific antibodies recognizing a number of *E. coli* proteins that were also present. Similar results were seen using sample number 659-99. Sample 55 also contained antibodies that recognized the known lung tumor antigen, NY-ESO-1.

The non-specific detection of, *E. coli* proteins is unwanted and was eliminated by developing a tumor associated (TA)-antigen specific peptide-array screening method, which is designed to span the entire length of the TA-antigen being evaluated, e.g., L523S. To do this, an array of peptides, representing a series of consecutive overlapping peptides (20 amino acids in length and overlapping by 10 amino acids) covering the entire length of L532S were synthesized. Each peptide was dispersed into individual wells of a multiwell plate and incubated with a serum sample obtained from lung cancer patients. An ELISA was used to detect the presence of antibodies recognizing a specific L523S peptide. The results from this analysis clearly indicated that antibodies contained in serum samples obtained from numerous lung cancer patients recognize L523S peptides as described further below and summarized in Table 25.

Antibodies contained in sera from patient 27 recognize peptide number 42 (amino acid sequence KIAPAEAPDAKVRMVIITGP) (SEQ ID NO:497 and SEQ ID NO:548), corresponding to amino acids 440-459 of lung TA-antigen L523S (SEQ ID NO:348). Additionally, competitive Western transfer and immunoblot analysis was then used to further characterize recognition of recombinant L523S by antibodies contained in patient serum samples 27 and 659-99. To do this, immunoblots were probed with the serum sample obtained from patient number 27 in the presence and absence of L523S peptide 42. The results indicate that peptide number 42 blocked detection of recombinant L523S by antibodies present in samples 27 and 659-99. Non-specific detection of E. coli proteins was not competed in the presence of L523S peptide 42.

Additional sera samples from lung cancer patients as well as normal donors were also evaluated by peptide-array analysis. In this study, patient sample 13 was also shown to contain antibodies recognizing L523S peptide number 42. Patient sample number 36 recognized peptides 5 (SEQ ID NO:508), 9 (SEQ ID NO:512) and to a lesser degree peptides 26, 33 and 52 (SEQ ID NOs:529, 537, and 559, respectively). The serum sample obtained from patient 197 contained antibodies strongly recognizing peptide 17 (SEQ ID NO:520), while peptides 13 (SEQ ID NO:516), 22 (SEQ ID NO:525) and 52 (SEQ ID NO:559) were detected to a lesser degree. Antibodies contained in lung pleural effusion fluid from patient sample number 10 recognized L523S peptide 15 (SEQ ID NO:518), 41 (SEQ ID NO:547), 42 (SEQ ID NO:548), 43 (SEQ ID NO:549) and 53 (SEQ ID NO:560). Lung pleural effusion fluid from patient 14 detected L523S peptide number 38 (SEQ ID NO:542). Lung pleural effusion fluid patient sample number 15 detected L523S peptides 35 and 53 (SEQ ID NOs:539 and 560, respectively). Lung pleural effusion sample 18 detected L523S peptides 42 and 33 (SEQ ID NOs:548 and 537, respectively). A composite multi TA-antigen peptide-array was used to evaluate the humoral response of patient number GB-56, detecting L523S peptide 12 (SEQ ID NO:515). Patient samples 208, GB-25, and GB-11 showed no reactivity with L523S peptides indicating that these samples do not contain L523S-specific antibodies. For control samples, serum was obtained from numerous normal donors (numbers 174, 365, 293, 17, 438, 445, 11, 480). All normal donors were negative for L523S-specific antibodies except normal donor sample 174 that had very low reactivity to peptides 11, 15, 18, 33 and 50 (SEQ ID NOs:514, 518, 521, 537, and 557, respectively).

In yet another study, a similar peptide array was used to measure the cellular immune response of several samples, essentially as described in Example 35. A cellular response (T cell) of patient number GB-56 was detected against a peptide pool containing L523S peptide numbers 30.5-35 (SEQ ID NOs:534-539), and another pool that contained peptide numbers 36-40.5 (SEQ ID NOs:540-546). A cellular immune response recognizing one or more peptides contained in the known lung tumor antigen, NY-ESO-1 was also detected. In particular, responses against a peptide pool containing peptides 13-17 was detected. A cellular immune response of patient GB-41 also detected signal in NY-ESO-1 peptide pools containing peptides 7-12 and 13-17.

TABLE 25

Summary of Antibody Epitopes of L523S

| Sample/Donor # | Sample Type | L523S peptide Epitope (SEQ ID NOs) |
|---|---|---|
| 27 | Serum | 42 (SEQ ID NO: 548), IMP-1 homologue of peptide 42 (SEQ ID NO: 498) |
| 55 | Serum | IMP-1 homologue of L523S peptide 32 (SEQ ID NO: 502), IMP-2 homologue of L523S peptide 32 (SEQ ID NO: 503) |
| 66 | Serum | Not Determined |
| 67 | Serum | Not Determined |
| 659-99 | Serum | 42 (SEQ ID NO: 548) |
| 13 | Serum | 42 (SEQ ID NO: 548), IMP-1 homologue of peptide 42 (SEQ ID NO: 498) |
| 36 | Serum | 5, 9, 26, 33, 52 (SEQ ID NOs: 508, 512, 529, 537, and 559, respectively) |
| 197 | Serum | 17, 13, 22, 52 (SEQ ID NOs: 520, 516, 525, and 559, respectively) |
| 10 | LPE | 15, 41, 42, 43, 53 (SEQ ID NOs: 518, 547–549, and 560, respectively) |
| 14 | LPE | 38 (SEQ ID NO: 542) |
| 15 | LPE | 35, 53 (SEQ ID NOs: 539 and 560) |
| 18 | LPE | 42, 33 (SEQ ID NOs: 548 and 537) |
| GB-56 | Serum | 12 (SEQ ID NO: 515) |
| 208 | | None Detected |
| GB-25 | | None Detected |
| GB-11 | | None Detected |
| 287 | Serum | 32 (SEQ ID NO: 461), IMP-1 homologue of L523S peptide 32 (SEQ ID NO: 502), IMP-2 homologue of L523S peptide 32 (SEQ ID NO: 503) |
| 290 | Serum | 32 (SEQ ID NO: 461), IMP-1 homologue of L523S peptide 32 (SEQ ID NO: 502), IMP-2 homologue of L523S peptide 32 (SEQ ID NO: 503) |

Analysis of the GenBank protein database revealed that the amino acid sequence of L523S (also referred to as IMP-3) peptide numbers 32 and 42 share partial homology with the corresponding peptides present in the L523S family members IMP-1 (SEQ ID NO:500) and IMP-2 (SEQ ID NO:501). Patient serum samples 13 and 27, which recognize L523S peptide number 42 (SEQ ID NO:548), were also evaluated for their ability to recognize the corresponding peptides of IMP-1, corresponding to amino acid sequence KIAPPETPDSKVRMVIITGP (SEQ ID NO: 498) and IMP-2 corresponding to amino acid sequence KIAPAEGPDVSERMVIITGP (SEQ ID NO:499). The data indicate that antibodies contained in serum from patient numbers 13 and 27 do recognize the IMP-1 peptide set forth in SEQ ID NO:498, but not the IMP-2 peptide set forth in SEQ ID NO:499.

In another series of experiments, patient serum sample 55 was comparatively evaluated for the presence of antibodies recognizing L523S peptide numbers 5 (SEQ ID NO:508), 9 (SEQ ID NO:512), 32 (SEQ ID NO:536) and 42 (SEQ ID NO:548). Cross reactivity with the corresponding partially homologous peptides from IMP-1 and IMP-2 was also determined. The data indicate that patient sample 55 did not recognize L523S peptides 5, 9 or 42, or the corresponding IMP-1 or IMP-2 peptides; no peptide in the array was detected by antibodies contained in serum samples obtained from normal donors, numbers 232 and 481. In addition, patient sample 55 did not recognize L523S peptide number 32, amino acid sequence LYNPERTITVKGNVETCAKA (SEQ ID NO:536)) but did recognize the corresponding partially homologous IMP-1 peptide corresponding to amino acid sequence LYNPERTITVKGAIENCCRA (SEQ ID NO:502) and IMP-2 peptide corresponding to amino acids sequence LYNPERTITVKGTCEACASA (SEQ ID NO:503). Similarly, patient sample numbers 287 and 290 were shown to contain antibodies that recognize L523S peptide number 32, and which cross-react at higher titer with the corresponding IMP-1 and IMP-2 peptides (the IMP-1 peptide being recognized more strongly than the IMP-2 peptide).

Homology search analysis indicates that L523S (IMP-3) has an overall amino acid sequence identity to IMP-1 and IMP-2 of 74% and 64%, respectively. However, in a similar analysis, L523S peptide number 3 (amino acid positions 20-39, SEQ ID NO:506) and peptide 53 (amino acid positions 560-579, SEQ ID NO:560) were shown to be non-homologous to the corresponding IMP-1 and IMP-2 peptide regions. Interestingly, patient sera were shown to react with peptide 53 in an additional study. Homology search indicated that peptide 24 of L523S (amino acid positions 230-249 (SEQ ID NO:527)) shares significant homology to IMP-1 (80%) and IMP-2 (70%). Lung cancer patient antibodies were also shown to be reactive with peptide 24 in a separate study. Patient sera also reacted against peptide 16 (SEQ ID NO:519). In a related study, patient sera was shown to react with peptides 34 and 37 (SEQ ID NOs:538 and 541).

In conclusion, the data described herein further confirms the in vivo immunogenicity of the L523S protein and further identifies peptides recognized by patient antibodies. These peptides can be used in immunotherapy or diagnostic applications for cancers associated with over-expression of L523S. The homology between L523S (IMP-3) and the family members IMP-1 and IMP-2, along with the cross-reactivity of antibodies obtained from patient's with lung cancer, suggest that, at least in some cases, a patient's immune response to L523S may cross react with IMP family members which are similarly overexpressed in lung tumors relative to normal tissue samples. Additionally, peptide-array analysis as described herein was used to characterize patient antibody responses based on antibody specificity, intensity and clonality. The identification of antigenic determinants using the peptide-array analysis as set forth herein, is useful for a variety of diagnostic, prognostic and therapeutic methods for lung cancer associated with expression of L523S either alone or in combination with other lung tumor antigens.

Example 44

Generation of Rabbit Polyclonal Antibodies Against L523S and Identification of L523S Epitopes Recognized by these Antibodies This example describes the generation of L523S-specific polyclonal antibodies in rabbits and the identification of specific epitopes recognized by these antibodies.

Polyclonal antibodies were prepared from rabbits immunized with recombinant L523S using techniques known in the art and analyzed by peptide-array for the presence of antibodies recognizing specific TA-antigen L523S antigenic epitopes. Polyclonal antibodies were L523S-affinity purified from rabbit serum and incubated with an L523S peptide-array as described in Example 43. Specific rabbit antibodies contained in this polyclonal serum sample strongly recognized peptide 32 (SEQ ID NO:536), moderately recognized peptides 16 and 17 (SEQ ID NOs:519 and 520), and to a lesser extent recognized peptides 2, 23, 24, 33, 49 and 53 (SEQ ID NOs:505, 526, 527, 537, 556, and 560).

Example 45

In Vivo Generation of Mouse Polyclonal Antibodies Against L523S Using a DNA/Adenovirus Prime Boost Regimen This example describes the in vivo generation of an L523S-sepcific B cell response and demonstrates that a DNA/Adenovirus prime-boost regimen can be used to induce a B cell (antibody) response against L523S. Further, specific epitopes recognized by mouse polyclonal antibodies are described.

Polyclonal serum was prepared from mice that were immunized with an L523S DNA/Adenovirus prime boost regimen, essentially as described in Example 33. High titers of mouse antibodies recognizing peptides 17, 22 and 53 (SEQ ID NOs: 520, 525, and 560, respectively) were detected. To a lesser degree, mouse antibodies recognizing peptides 32, 19 and 18 (SEQ ID NOs:536, 522, and 521, respectively) were also detected. Antibodies specific for adenovirus proteins were also detected that coincided with the detection of L523S-specific antibodies. No signal was detected using serum from control naïve mice or mice immunized with an antigen unrelated to L523S. As was shown previously in Examples 33 and 37, both CD4 and CD8 responses specific for L523S were also detected. Thus, this experiment confirms the in vivo immunogenicity of L523S and demonstrates that a DNA/Adenovirus primer boost regimen can be used to induce a B cell (antibody) response against L523S.

Example 46

In Vivo Immunogenicity of Lung Tumor Antigen L523S: L523S and Adenovirus-Specific Humoral Responses in Monkeys Immunized with L523S-DNA/Adenovirus Regimen This example describes an in vivo immunogenicity study in rhesus macaque monkeys to evaluate the safety of the vaccine regimen administered as two priming doses of; VAC/L523S and 2 boosting doses of Ad/L523S. Vaccination with L523S naked DNA was followed by a second immunization with either low or high dose of an adenovirus containing L523S. The results further validate the use of L523S DNA and L523S adenovirus prime/boost regimens in generating in vivo immune responses to this lung tumor antigen in vivo.

Three groups of monkeys were immunized intradermally. Monkeys were immunized three times with DNA followed by three adenovirus-L523S boosts. Antibody responses to L523S were examined in all groups of monkeys on the following days:

−1: one day prior to the 1st DNA-L523S prime

+3: 3 days after the 1st DNA-L523S prime

+31: 2 days after the 3rd DNA-L523S prime
+45: 2 days after the 1st adeno-L523S boost
+73: 2 days after the 3rd adeno-L523S boost
+86: 15 days after the 3rd adeno-L523S boost The results showed that all pre-bleed monkeys had no antibody titers specific for L523S and adenovirus particle (SEA-adeno). L523S-DNA priming alone did not induce a significant L523S-specific antibody response. In Group 2 monkeys (monkeys that received low-dose adeno-L523S), 1 of 6 monkeys had a weak antibody response to L523S while 6 of 6 monkeys demonstrated a moderate adenovirus-specific antibody response. In Group 3 (monkeys that received high-dose adeno-L523S), 3 of 6 monkeys had a strong L523S-specific antibody response while 6 of 6 monkeys had a strong adenovirus-specific response. Both male and female monkeys generated antibody responses to L523S and adenovirus. No apparent untoward toxicity was observed in any of the vaccinated monkeys.

Thus, the above experiments further confirm that L523S is immunogenic in vivo and thus has utility as a target for vaccine and other immunotherapeutic strategies. In particular, this study shows that DNA prime followed by high-dose adenovirus boost generates a strong L523S and adenovirus antibody response.

Example 47

Development of an In Vivo Metastatic Tumor Model for the L762P Lung Tumor Antigen This example describes the ability of the lung tumor line 343T/L762P to form three times as many lung tumor foci in CB17 SCID mice as the 343T parent cell line. This example confirms that L762P (full-length cDNA and protein sequence set forth in SEQ ID NOs:160 and 161, respectively) is a lung tumor antigen and further, shows that the CB17 SCID mouse injected with the 343T/L762P cell line is an in vivo model useful for development of therapeutics for lung cancers associated with expression of L762P.

The 343T/L762P cell line was generated by transduction of the 343T tumor cell line with a retroviral vector comprising L762P (cDNA set forth in SEQ ID NO:160, amino acid sequence set forth in SEQ ID NO:161), followed by selection resulting in a line that stably expressed L762P, as described further below. Specifically, recombinant retroviruses were generated using the Phoenix-Ampho packaging system and the vectors pBiB that includes a polylinker and the Blasticidin-D selectable marker. The cDNA for L762P was subcloned into the pBiB vector using standard molecular techniques. The consensus Kozak sequence GCCACC was included immediately 5' of the initiator ATG to maximize translational initiation. As would be recognized by the skilled artisan, any number of retrovirus vectors available in the art can be used in the context of this invention. To characterize surface expression of L762P, the retrovirus construct that expressed L762P was used to transduce the lung tumor cell line 343T. Transduced lines were selected with Blasticidin-S and expanded to examine L762P surface expression by flow cytometric analysis. For this analysis, non-transduced and transduced cells were washed and incubated with 10-50 micrograms/ml of affinity purified anti-L762P. Following a 30 minute incubation on ice, cells were washed and incubated with a secondary, FITC-conjugated anti-rabbit IgG antibody as above. Cells were washed, resuspended in buffer with Propidium Iodide (PI) and examined by flow cytometry using an Excalibur fluorescence activated cell sorter. For this analysis, PI-positive (i.e., dead/permeabilized cells) were excluded. The anti-L762P sera specifically recognized and bound to the surface of L762P-transduced cells but not the non-transduced counterparts. These results demonstrated that L762P is localized to the cell surface of lung tumor cells.

Two groups of CB17 SCID mice were injected with $4 \times 10^6$ cells intravenously of either 343T or 343T/L762P cells. Mice were euthanized after 42 days and examined for lung tumor foci formation. The average number of foci formation in 343T/L762P-injected mice was 216.8 foci (total for both lungs) as compared to 70.3 in the non-transduced parent 343T cell line, giving a ratio of 3.08. Thus, mice injected with the L762P-expressing cell line form three times as many lung tumor foci as mice injected with the parent 343T (non-L762P expressing) cell line.

Example 48

Comparisons of Lung Weight in a 343T/L762P Metastatic Tumor Model

This example shows that the ability of the L762P-expressing 343T/L762P cell line to establish tumors in CB17 SCID mice is significantly greater than the non-L762P-expressing parent 343T cell line.

Two groups of CB17 SCID mice were injected with $4 \times 10^6$ cells intravenously with either 343T/L762P or 343T/EGFP cells. These two cell lines were generated by transduction of the 343T tumor cell line with a retroviral vector comprising either L762P (cDNA set forth in SEQ ID NO:160, amino acid sequence set forth in SEQ ID NO:161), or EGFP, followed by selection resulting in cell lines that stably expressed either L762P or the control marker EGFP, as described in Example 47. An additional group of mice received no injections of cells. Mice were euthanized after losing 20% of their body weight or 33 days post cell injection, whichever came first. The average weight of lungs from 343T/L762P, 343T/EGFP and uninjected mice were 0.556 g, 0.3 g, and 0.1817 g, respectively. Student T-test analysis showed that the probability of the means of the three groups being equal to one another were as follows: 343T/L762P vs. Uninjected: p=0.0027; 343T/L762P vs. 343T/EGFP: p=0.0589; 343T/EGFP vs. Uninjected: p=0.1129.

Thus the 343T/L762P lung tumor cell line, which stably expresses the L762P protein, forms significantly greater mass of lung tumors in intravenously injected CB17 SCID mice as compared to the lungs of uninjected mice. Additionally, 343T/L762P-injected mice also have lung tumor mass greater than mice injected with the control tumor cell line, 343T/EGFP.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (560 sequences)

SEQ ID NO: 1 - DNA, 315 bp, Homo sapiens
  misc_feature 236, 241: n = A,T,C or G
gcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaagcaatgggaanggtanaaattacaaatagaatcatttgctgtaatccttaaatggcaaacggtcaggccacgtgaaaaaaaaaaaaaaaa

SEQ ID NO: 2 - DNA, 380 bp, Homo sapiens
atttaggcttaagattttgtttacccttgttactaaggagcaaattagtattaaagtataatatatataaacaaatacaaaaagttttgagtggttcagcttttttattttttttaatggcataacttttaacaacactgctctgtaatgggttgaactgtggtactcagactgagataactgaaatgagtggatgtatagtgttattgcataattatcccactatgaagcaaagggactggataaattcccagtctagattattagcctttgttaaccatcaagcacctagaagaagaattattggaaattttgtcctctgtaactggcactttggggtgtgacttatcttttgcctttgtaaaaaaaaaaaaaaaaaa

SEQ ID NO: 3 - DNA, 346 bp, Homo sapiens
  misc_feature 316, 317, 318, 322, 323, 326, 329, 330, 331, 336, 337, 339,340, 342, 343: n = A,T,C or G
ttgtaagtatacaattttagaaaggattaaatgttattgatcattttactgaatactgcacatcctcaccatacaccatccactttccaataacatttaatcctttctaaaattgtaagtatacaattgtactttctttggattttcataacaaatataccatagactgttaattttattgaagtttccttaatggaatgagtcatttttgtcttgtgcttttgaggttacctttgctttgacttccaacaatttgatcatatagtgttgagctgtggaaatctttaagtttattctatagcaataatttctattnnnagannccnggnnnaaaannannannaaa

SEQ ID NO: 4 - DNA, 372 bp, Homo sapiens
  misc_feature 297, 306, 332: n = A,T,C or G
actagtctcattactccagaattatgctcttgtacctgtgtggctgggtttcttagtcgttggtttggtttggttttttgaactggtatgtagggtggttcacagttctaatgtaagcactctcttctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagaaggggatgcngggaaggantgggtgctttgtgatggataaaacgnctaaataacacacctttacattttgaaaaaaacaaaacaa

SEQ ID NO: 5 - DNA, 698 bp, Homo sapiens
  misc_feature 8, 345, 422, 430, 433, 436, 438, 472, 481, 486, 515, 521,536, 549, 553, 556, 557, 559, 568, 593, 597, 605, 611, 613,616, 618, 620, 628, 630, 632, 634, 635, 639, 643, 647, 648,649, 652, 654, 658, 664, 690: n = A,T,C or G
actagtangatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttgggtgacaacctactttgcttggctgagtgaaggaatgatattcatatnttcatttattccatggacatttagttagtgctttttatataccaggcatgatgctgagtgacactcttgtgtatatntccaaatnttngtncngtcgctgcacatatctgaaatcctatattaagantttcccaanatgangtccctggtttttccacgccacttgatcngtcaangatctcacctctgtntgtcctaaaaccntctnctnnanggttagacnggacctctcttctcccttcccgaanaatnaagtgtgngaagananccncncncccccctncntncnncctngccngctnnnccncntgtngggggngccgcccccgcggggggacccccccnttttcccc

SEQ ID NO: 6 - DNA, 740 bp, Homo sapiens
  misc_feature 82, 406, 426, 434, 462, 536, 551, 558, 563, 567, 582, 584,592, 638, 651, 660, 664, 673, 675, 697, 706, 711, 715, 716,717, 723, 724, 725, 733: n = A,T,C or G
actagtcaaaaatgctaaaataatttgggagaaaatattttttaagtagtgttatagtttcatgtttatcttttattatgtnttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggacttggtctgttaaggggctaagggagaagaagaagataaggttaaaagttgttaatgaccaaacattctaaaagaaatgcaaaaaaaaatttattttcaagccttcgaactatttaaggaaagcaaaatcatttcctanatgcatatcatttgtgagantttctcantaatatcctgaatcattcatttcagctnaggcttcatgttgactcgatatgtcatctagggaaagtctatttcatggtccaaacctgttgccatagttggtnaggctttcctttaantgtgaantattnacangaaattttctctttnanagttcttnatagggttaggggtgtgggaaaagcttctaacaatctgtagtgttncgtgttatctgtncagaaccanaatnacggatcgnangaaggactgggtctatttacangaacgaatnatctngttnnntgtgtnnncaactccngggagcc

SEQ ID NO: 7 - DNA, 670 bp, Homo sapiens
  misc_feature 265, 268, 457, 470, 485, 546, 553, 566, 590, 596, 613, 624,639, 653, 659, 661: n = A,T,C or G
gctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagaccgcgagttcctggcgcacagcgccaaggtgcactcggtggcctggagttgcgacgggcgtcgcctacctcggggtcttcgacaagacgccacgtcttcttgctgganaangaccgttggtcaaagaaaacaattatcggggacatggggatagtgtggaccactttgttggcatccaagtaatcctgacctatttgttacggcgtctggagataaaaccattcgcatctgggatgtgaggactacaaaatgcattgccactgtgaacactaaaggggagaacattaatatctgctggantcctgatgggcanaccattgctgtagcnacaaggatgatgtggtgactttattgatgccaagaaaccccgttccaaagcaaaaaaacanttccaanttcgaagtcaccnaaatctcctggaacaatgaacatnaatatnttcttcctgacaatggnccttgggtgtntcacatcctcagctnccccaaaactgaancctgtncnatccacccc

SEQ ID NO: 8 - DNA, 689 bp, Homo sapiens
  misc_feature 253, 335, 410, 428, 448, 458, 466, 479, 480, 482, 483, 485,488, 491, 492, 495, 499, 500, 502, 503, 512, 516, 524, 525,526, 527, 530, 540, 546, 550, 581, 593, 594, 601, 606, 609,610, 620, 621, 622, 628, 641, 646, 656, 673: n = A,T,C or G
actagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaagganagacagcccccattaccaaataccatttttgcctggggcttgtgcagctggcagtgttcctgccccagcatggcaccttatngttttgatagcaacttcgttgaattttcaccaacttattacttgaaattataatatagcctgtccgtttgctgtntccaggctgtgatatatnttcctagtggtttgactttnaaaataaatnaggtttanttttctccccccnncnntnctnccnntcnctcnncnntcccccccnctcngtcctccnnnnttngggggggccncccccncggnggacccccctttggtcccttagtggaggttnatggcccctggnnttatccnggccntanntttccccgtnnnaaatgnttccccctcccantcccnccacctcaanccggaagcctaagtttntaccctgggggtcccc

SEQ ID NO: 9 - DNA, 674 bp, Homo sapiens
  misc_feature 602, 632, 639, 668: n = A,T,C or G
gtccactctcctttgagtgtactgtcttactgtgcactctgtttttcaactttctagatataaaaaatgcttgttctatagtggagtaagagctcacacacccaaggcagcaagataactgaaaaaagcgaggcttttttgccaccttggtaaaggccagttcactgctatagaactgctataagcctgaagggaagtagctatgagactttccatttttcttagttctcccaataggctccttcatggaaaaaggcttcctgtaataattttcacctaatgaattagcagtgtgattatttctgaaataagagacaaattgggccgcagagtcttcctgtgatttaaaataaacaacccaaagttttgtttggtcttcaccaaaggacatactctagggggtatgttgttgaagacattcaaaaacattagctgttctgtctttcaatttcaagttattttggagactgcctccatgtgagttaattactttgctctggaactagcattattgtcattatcatcacattctgtcatcatcatctgaataatattgtggatttccccctctgcttgcatcttcttttgactcctctgggaanaaatgtcaaaaaaaaaggtcgatctactcngcaaggnccatctaatcactgcgctggaaggacccnctgccc

SEQ ID NO: 10 - DNA, 346 bp, Homo sapiens
  misc_feature 320, 321, 322, 325, 326, 328, 329, 330, 332, 333, 334, 335,342: n = A,T,C or G
actagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattannnagnngnnngnnnnataaaanaaaa

SEQ ID NO: 11 - DNA, 602 bp, Homo sapiens
actagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagttataaatcaatttttgtataatctgtttgaaacatgagttttatttgcttaatattagggctttgccccttttctgtaagtctcttgggatcctgtgtagaactgttctcattaaacaccaaacagttaagtccattctctggtactagctacaaattcggtttcatattctacttaacaatttaaataaactgaaatatttctagatggtctacttctgttcatataaaaacaaaacttgatttccaaaaaaaaaaaaaaaaa

SEQ ID NO: 12 - DNA, 685 bp, Homo sapiens
  misc_feature 170, 279, 318, 321, 322, 422, 450, 453, 459, 467, 468, 470,473, 475, 482, 485, 486, 491, 498, 503, 506, 509, 522, 526,527, 528, 538, 542, 544, 551, 567, 568, 569, 574, 576, 582,587, 588, 589, 590, 592, 593, 598, 599, 603, 605, 608: n = A,T,C or G
  misc_feature 633, 634, 635, 644, 646, 648, 651, 655, 660, 662, 663, 672,674, 675, 682, 683: n = A,T,C or G
actagtcctgtgaaagtacaactgaaggcagaaagtgttaggattttgcatctaatgttcattatcatggtattgatggacctaagaaaataaaaattagactaagcccccaaataagctgcatgcatttgtaacatgattagtagatttgaatatatagatgtagtatnttgggtatctaggtgttttatcattatgtaaaggaattaaagtaaaggactttgtagttgtttttattaaatatgcatatagtagagtgcaaaaatatagcaaaaatanaaactaaaggtagaaaagcattttagatatgccttaatntannaactgtgccaggtggccctcggaatagatgccaggcagagaccagtgcctgggtggtgcctccccttgtctgcccccctgaagaacttccctcacgtgangtagtgccctcgtaggtgtcacgtggantantgggancaggccgnncngtnanaagaaancanngtganagtttcnccgtngangcngaactgtccctgngccnnnacgctcccanaacntntccaatngacaatcgagtttccnnnctccngnaacctngccgnnnncnngcccnnccantntgntaaccccgcgcccggatcgctctcnnntcgttctcncncnaangggntttcncnnccgccgtcncnnccccgcnncc

SEQ ID NO: 13 - DNA, 694 bp, Homo sapiens
  misc_feature 503, 546, 599, 611, 636, 641, 643, 645, 656, 658, 662, 676,679, 687: n = A,T,C or G
cactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttctctgtgtgtgcaaatgtgtgtttgtgatccattttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtactactttaacagatggaaagaactcattggccatggaaacagccgangtgttgggagccagcagtgcatggcaccgtccggcatctggcntgattggtctggctgccgtcattgtcagcacagtgccatgggacatggggaanactgactgcacngccaatggttttcatgaagaatacngcatncncngtgatcacgtnanccangacgctatgggggncanagggccanttgcttc

SEQ ID NO: 14 - DNA, 679 bp, Homo sapiens
  misc_feature 29, 68, 83, 87, 94, 104, 117, 142, 145, 151, 187, 201, 211,226, 229, 239, 241, 245, 252, 255, 259, 303, 309, 359, 387,400, 441, 446, 461, 492, 504, 505, 512, 525, 527, 533, 574,592, 609, 610, 618, 620, 626, 627, 633, 639, 645, 654: n = A,T,C or G
cagccgcctgcatctgtatccagcgccangtcccgccagtcccagctgcgcgcgccccccagtcccgnacccgttcggcccangctnagttagncctcaccatnccggtcaaaggangcaccaagtgcatcaaatacctgcngtncggatntaaattcatcttctggcttgccgggattgctgtccntgccattggactanggctccgatncgactctcagaccangancatcttcgancnaganactaatnatnattnttccagcttctacacaggagtctatattctgatcggatccggcnccctcntgatgctggtgggcttcctgagctgctgcggggctgtgcaagagtcccantgcatgctgggactgttcttcggcttcntcttggtgatatncgccattgaaatacctgcggccatctggggatattccactncgatnatgtgattaaggaantccacggagttttacaaggacacgtacaacnacctgaaaaccnnggatganccccaccgggaancnctgaangccatccactatgcgttgaactgcaatggtttggctggggnccttgaacaatttaatcncatacatctggccccannaaaggacntnctcgannccttcnccgtgnaattcngttctgatnccatcacagaagtctcgaacaatcc

SEQ ID NO: 15 - DNA, 695 bp, Homo sapiens
  misc_feature 105, 172, 176, 179, 189, 203, 212, 219, 221, 229, 231, 238,242, 261, 266, 270, 278, 285, 286, 298, 311, 324, 337, 350,363, 384, 391, 395, 405, 411, 424, 427, 443, 448, 453, 455,458, 463, 467, 470, 479, 482, 484, 493, 499, 505, 518: n = A,T,C or G
  misc_feature 520, 523, 531, 540, 584, 595, 597, 609, 611, 626, 628, 651,652, 657, 661, 665, 669, 672, 681, 683, 691, 693: n = A,T,C or G
actagtggataaaggccagggatgctgctcaacctcctaccatgtacagggacgtctccccattacaactacccaatccgaagtgtcaactgtgtcaggactaanaaaccctggttttgattaaaaaagggcctgaaaaaaggggagccacaaatctgtctgcttcctcacnttantcnttggcaaatnagcattctgtctcnttggctgcngcctcancncaaaaaancngaactcnatcnggcccaggaatacatctcncaatnaacnaaattgancaaggcnntgggaaatgccngatgggattatcntccgcttgttgancttctaagtttcnttcccttcattcnaccctgccagccnagttctgttagaaaaatgccngaattcnaacnccggttttcntactcngaatttagatctncanaaacttcctggccacnattcnaattnanggncacgnacanatnccttccatnaancncaccccacntttganagccangacaatgactgcntnaantgaaggcntgaaggaanaactttgaaaggaaaaaaaactttgtttccggccccttccaacncttctgtgttnancactgccttctngnaaccctggaagcccngngacagtgttacatgttgttctannaaacngacncttnaatntcnatcttcccnanaacgattncncc

SEQ ID NO: 16 - DNA, 669 bp, Homo sapiens
  misc_feature 299, 354, 483, 555, 571, 573, 577, 642, 651, 662, 667: n = A,T,C or G
cgccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcnggagactacaacatggccaaagccaacatgaagaataagcagctgccaagtgcangaccagacaagaacctggtgactggtgatcacatccccaccccacaggatctgcccagagaaagtcctcgctcgtcaccagcaagcttgcgggtggccaagttgaatgatgctgccggggctctgccanatctgagacgcttccctccctgccccacccgggtcctgtgctggctcctgcccttcctgcttttgcagccangggtcaggaagtggcncnggtngtggctggaaagcaaaaccctttcctgttggtgtcccacccatggagcccctggggcgagcccangaacttgancctttttgttntcttncc

SEQ ID NO: 17 - DNA, 697 bp, Homo sapiens
  misc_feature 33, 48, 50, 55, 59, 60, 76, 77, 78, 90, 113, 118, 130, 135,141, 143, 150, 156, 166, 167, 170, 172, 180, 181, 190, 192,194, 199, 201, 209, 212, 224, 225, 226, 230, 233, 234, 236,242, 244, 251, 253, 256, 268, 297, 305, 308, 311, 314: n = A,T,C or G
  misc_feature 315, 317, 322, 324, 327, 333, 337, 343, 362, 364, 367, 368,373, 384, 388, 394, 406, 411, 413, 423, 429, 438, 449, 450,473, 476, 479, 489, 491, 494, 499, 505, 507, 508, 522, 523,527, 530, 533, 535, 538, 539, 545, 548, 550, 552, 555: n = A,T,C or G
  misc_feature 562, 563, 566, 568, 572, 577, 578, 580, 581, 591, 594, 622,628, 632, 638, 642, 644, 653, 658, 662, 663, 665, 669, 675,680, 686, 689: n = A,T,C or G
gcaagatatggacaactaagtgagaaggtaatnctctactgctctagntnctccnggcnngacgcgctgaggagannnacgctggcccanctgccggccacacacggggatcntggtnatgcctgcccanggganccccancnctcggancccatntcacacccgnnccntncgcccacnncctggctcncncngcccngnccagctcncgnccccctccgccnnnctcnttnncntctccncnccctccncnacnacctcctacccncggctccctccccagcccccccccgcaancctccacnacnccntcnncncgaancnccnctcgcnctcngccccngccccctgccccccgcccncnacnncgcgntcccccgcgcncgcngcctcnccccctcccacnacagncncacccgcagncacgcnctccgcccnctgacgccccnncccgccgcgctcaccttcatggnccnacngccccgctcncnccnctgcncgccgncnnggcgccccgccccnnccgngtnccncncgnngccccngcngnangcngtgcgcnncangnccgngccgnncnncaccctccgnccnccgccccgcccgctgggggctcccgccncgcggntcantccccncccntncgcccactntccgntccnncnctcncgctcngcgcncgcccnccncccccccc

SEQ ID NO: 18 - DNA, 670 bp, Homo sapiens
  misc_feature 234, 292, 329, 437, 458, 478, 487, 524, 542, 549, 550, 557,576, 597, 603, 604, 646, 665: n = A,T,C or G
ctcgtgtgaagggtgcagtacctaagccggagcggggtagaggcgggccggcacccccttctgacctccagtgccgccggcctcaagatcagacatggcccagaacttgaacgacttggcgggacggctgcccgccgggccccggggcatgggcacggccctgaagctgttgctgggggccggcgccgtggcctacggtgtgcgcgaatctgtgttcaccgtggaaggcgggcncagagccatcttcttcaatcggatcggtggagtgcacaggacactatcctgggccganggccttcacttcaggatccttggttccagtaccccancatctatgacattcgggccagacctcgaaaaaatctcctccctacaggctccaaagacctacagatggtgaatatctccctgcgagtgttgtctcgaccaatgctcangaacttcctaacatgttccancgcctaagggctggactacnaagaacgantgttgccgtccattgtcacgaagtgctcaagaatttnggtggccaagttcaatgncctcacnnctgatcncccagcggggccaagttanccctggttgatccccgggganctgacnnaaaagggccaaggacttcccctcatcctggataatgtggccntcacaaagctcaactttanccacc

SEQ ID NO: 19 - DNA, 606 bp, Homo sapiens
  misc_feature 506: n = A,T,C or G
actagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttnagaacattcctaggtggccttattctaataagtttcttctgtctgttttgtttttcaattgaaaagttattaaataacagatttagaatctagtgagacc

SEQ ID NO: 20 - DNA, 449 bp, Homo sapiens
actagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcaaaa

SEQ ID NO: 21 - DNA, 409 bp, Homo sapiens
tatcaatcaactggtgaataattaaacaatgtgtggtgtgatcatacaaagggtaccactcaatgataaaaggaacaagctgcctatatgtggaacaacatggatgcatttcagaaactttatgttgagtgaaagaacaaacacggagaacatactatgtggttctctttatgtaacattacagaaataaaaacagaggcaaccacctttgaggcagtatggagtgagatagactggaaaaaggaaggaaggaaactctacgctgatggaaatgtctgtgtcttcattgggtggtagttatgtggggatatacatttgtcaaaatttattgaactatatactaaagaactctgcattttattgggatgtaaataatacctcaattaaaaagacaaaaaaaaaaaaaaaa

SEQ ID NO: 22 - DNA, 649 bp, Homo sapiens
  misc_feature 263, 353, 610, 635, 646: n = A,T,C or G
acaattttcattatcttaagcacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgttttgttttctttgttttttcccccttctcctgaatcagcagggatggaangagggtagggaagttatgaattactccttccagtagtagctctgaagtgtcacatttaatatcagttttttttaaacatgattctagttnaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactaggggcatatatattttttttttttgtaagctgtttcatgatgttttctttggaatttccggataagttcaggaaaacatctgcatgttgttatctagtctgaagttcntatccatctcattacaacaaaaacncccagaacggnttg

SEQ ID NO: 23 - DNA, 669 bp, Homo sapiens
  misc_feature 642, 661: n = A,T,C or G
actagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagacttgaacaagttcaattttgccaggaacagtaccctcaactcagccgctgtcaccgtctcctcttagagctcactcgggccaggccctgatctgcgctgtggctgtcctggacgtgctgcaccctctgtccttccccccagtcagtattacctgtgaagcccttccctcctttattattcagganggctgggggggctccttgnttctaacc

SEQ ID NO: 24 - DNA, 442 bp, Homo sapiens
actagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttggtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacctaaaaaaaaaaaaagaaa

SEQ ID NO: 25 - DNA, 656 bp, Homo sapiens
  misc_feature 330, 342, 418, 548, 579, 608: n = A,T,C or G
tgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggangccatggagganctctagaaacattagcatgggctgatctgattacttcctggcatcccgctcacttttatgggaagtcttattaganggatgggacagttttccatatccttgctgtggagctctggaacactctctaaatttccctctattaaaaatcactgccctaactacacttcctccttgaaggaatagaaatggaactttctctgacatanttcttggcatggggagccagccacaaatganaatctgaacgtgtccaggtttctcctganactcatctacatagaattggttaaaccctcccttggaataaggaaaaa

SEQ ID NO: 26 - DNA, 434 bp, Homo sapiens
  misc_feature 395: n = A,T,C or G
actagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaataactgaattgtcaggctttgattgataattgtagaaataagtagccttctgttgtgggaataagttataatcagtattcatctctttgttttttgtcactcttttctctctaattgtgtcatttgtactgtttgaaaaatatttcttctatnaaattaaactaacctgccttaaaaaaaaaaaaaaaaaaa

SEQ ID NO: 27 - DNA, 654 bp, Homo sapiens
  misc_feature 505, 533, 563, 592, 613, 635, 638: n = A,T,C or G
actagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcagganctcagtatggcaaaggtcttgagaatcngccatttggtacaaaaaaaattttaaagcntttatgttataccatggaaccatagaaanggcaagggaattgttaagaanaattttaagtgtccagacccanaangaaaaaaaaaaaaaaa

SEQ ID NO: 28 - DNA, 670 bp, Homo sapiens
  misc_feature 101, 226, 274, 330, 385, 392, 397, 402, 452, 473, 476, 532,534, 538, 550, 583, 595, 604, 613, 622, 643, 669: n = A,T,C or G
cgtgtgcacatactgggaggatttccacagctgcacggtcacagcccttacggattgccaggaaggggcgaaagatatgtgggataaactgagaaaagaanccaaaaacctcaacatccaaggcagcttattcgaactctgcggcagcggcaacggggcggcggggtccctgctcccggcgttcccggtgctcctggtgtctctctcggcagctttagcgacctgnctttccttctgagcgtggggccagctccccccgcggcgcccacccacnctcactccatgctcccggaaatcgagaggaagatcattagttctttggggacgttngtgattctctgtgatgctgaaaaacactcatatagggaatgtgggaaatcctganctctttnttatntcgtntgatttcttgtgttttatttgccaaaatgttaccaatcagtgaccaaccnagcacagccaaaaatcggacntcngctttagtccgtcttcacacacagaataagaaaacggcaaacccaccccacttttnantttnattattactaanttttttctgttgggcaaaagaatctcaggaacngccctggggccnccgtactanagttaaccnagctagttncatgaaaaatgatgggctccncctcaatgggaaagccaagaaaaagnc

SEQ ID NO: 29 - DNA, 551 bp, Homo sapiens
  misc_feature 336, 474, 504, 511, 522, 523, 524, 540, 547: n = A,T,C or G
actagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacncagatgcttccaaatccttcttccaaagcaatagctgatgggaagaggagctccagcagcagcaggaatatcgaaaacagaaaaaaaagtgaaattgggaagacaaaagctcaacagcatttggtaaggagaaaaganaagatgaggaaggaagagagaagagagacnaagatcnctacggaccgnnncggaagaagaagaagnaaaaaanaaaa

SEQ ID NO: 30 - DNA, 684 bp, Homo sapiens
  misc_feature 545, 570, 606, 657, 684: n = A,T,C or G
actagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcgggagtcttcagatacactgtgtcctcgatgtgcagaagttgtcagtgggaaaatagtattaacagctcactcgagcaagaaccctcctgacagtactgggctagaagtttggatggattatttacaatataggaaagaaagccaagaattaggtnatgagtggatgagtaaatggtggangatggggaattcaaatcagaattatggaagaagttnttcctgttactatagaaaggaattatgtttatttacatgcagaaaatatanatgtgtggtgtgtaccgtggatggaan

SEQ ID NO: 31 - DNA, 654 bp, Homo sapiens
  misc_feature 326, 582, 651: n = A,T,C or G
gcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcagggaaagcaaatcagangttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactgggagatatcaaggaactccatgctccactgactgttgttgcagatgggcttttctccaanttcaggaaaagcctggtctcaataaagtttctgtatcactcatttggttggcttcttatgaagaatgcnccc

SEQ ID NO: 32 - DNA, 673 bp, Homo sapiens
  misc_feature 376, 545, 627: n = A,T,C or G
actagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatnagccaattattaaaaaatacaccaaaatcattgatgggagtgcctgtgggaaataactgaaaaagagaccgagaagaacgaatcattacaggtcctgaaataaaatacctaggatttctactggaggtggagaaacagaagaactctgaagaaattgttacaagaagangtcccaaggtcaccaaattcattgaaggtggtgatggtctttatttgaagatgaagaaattaaaagacgcttcagggagacnccccatgaaggaattgccagccacaaaaaaattcagggattagaaa

SEQ ID NO: 33 - DNA, 673 bp, Homo sapiens
  misc_feature 325, 419, 452, 532, 538, 542, 571, 600, 616, 651, 653, 672: n = A,T,C or G
actagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttnaagacttaagactttaacctgctggcagtcccaaatgaaattatgcaactttgatatcatattccttgatttaaattgggcttttgtgattgantgaaactttataaagcatatggtcagttatttnattaaaaaggcaaaacctgaaccaccttctgcacttaaagaagtctaacagtacaaatacctatctatcttagatggatntatttntttntatttttaaatattgtactatttatggtnggtggggctttcttactaatacacaaatnaatttatcatttcaanggcattctatttgggtttagaagttgattccaagnantgcatatttcgctactgtnt

SEQ ID NO: 34 - DNA, 684 bp, Homo sapiens
  misc_feature 414, 472, 480, 490, 503, 507, 508, 513, 523, 574, 575, 598,659, 662, 675: n = A,T,C or G
actagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaagtgggcactgttatggctgggtatggagcggacagccccaggaatcagagcctcagcccggctgcctggttggaaggtacaggtgttcagcaccttcggaaaaagggcataaagtngtgggggacaattctcagtccaagaagaatgcattgaccattgctggctatttgcttncctagtangaattggatncatttttgaccangatnnttctnctatgctttnttgcaatgaaatcaaatcccgcattatctacaagtggtatgaagtcctgcnncccccagagaggctgttcaggcnatgtcttccaagggcagggtgggttacaccattttacctcccctctccccccagattatgnacncagaaggaatttntttcctccc

SEQ ID NO: 35 - DNA, 614 bp, Homo sapiens
  misc_feature 17, 20, 152, 223, 267, 287, 304, 306, 316, 319, 321, 355,365, 382, 391, 407, 419, 428, 434, 464, 467, 477, 480, 495,499, 505, 515, 516, 522, 524, 527, 542, 547, 549, 567, 572,576, 578: n = A,T,C or G
actagtccaacgcgttngcnaatattcccctggtagcctacttccttacccccgaatattggtaagatcgagcaatggcttcaggacatgggttctcttctcctgtgatcattcaagtgctcactgcatgaagactggcttgtctcagtgtntcaacctcaccagggctgtctcttggtccacacctcgctccctgttagtgccgtatgacagcccccatcanatgaccttggccaagtcacggtttctctgtggtcaatgttggtnggctgattggtggaaagtanggtggaccaaaggaagncncgtgagcagncancnccagttctgcaccagcagcgcctccgtcctactngggtgttccngtttctcctggccctgngtgggctanggcctgattcgggaanatgcctttgcanggaagggangataantgggatctaccaattgattctggcaaaacnatntctaagattnttntgctttatgtggganacanatctanctctcatttnntgctgnanatnacaccctactcgtgntcgancncgtcttcgattttcgganacacnccantnaatactggcgttctgttgttaaaaaaaaaaaaaaaa

SEQ ID NO: 36 - DNA, 686 bp, Homo sapiens
  misc_feature 222, 224, 237, 264, 285, 548, 551, 628, 643, 645, 665, 674: n = A,T,C or G
gtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagananaaaagacacgacnaacctcagctcgccagtccggtcgctngcttcccgccgcatggcaatnagacagacgccgctcacctgctctgggcacacgcgacccgtggttgatttggccttcagtggcatcacccttatgggtatttcttaatcagcgcttgcaaagatggttaacctatgctacgccagggagatacaggagactggattggaacatttttggggtctaaaggtctgtttggggtgcaacactgaataaggatgccaccaaagcagctacagcagctgcagatttcacagcccaagtgtgggatgctgtctcagganatnaattgataacctggctcataacacattgtcaagaatgtggatttccccaggatattattatttgtttaccggggganaggataactgtttcncntattttaattgaacaaactnaaacaaaanctaaggaaatcc

SEQ ID NO: 37 - DNA, 681 bp, Homo sapiens
  misc_feature 7, 10, 11, 19, 25, 32, 46, 53, 77, 93, 101, 103, 109, 115,123, 128, 139, 157, 175, 180, 192, 193, 194, 212, 218, 226,227, 233, 240, 241, 259, 260, 267, 289, 296, 297, 298, 312,313, 314, 320, 325, 330, 337, 345, 346, 352, 353, 356: n = A,T,C or G
  misc_feature 382, 385, 400, 427, 481, 484, 485, 491, 505, 515, 533, 542,544, 554, 557, 560, 561, 564, 575, 583, 589, 595, 607, 619,628, 634, 641, 645, 658, 670: n = A,T,C or G
gagacanacnnaacgtcangagaanaaaagangcatggaacacaanccaggcncgatggccaccttcccaccagcanccagcgccccccagcngcccccangnccggangaccangactccancctgnatcaatctganctctattcctggcccatncctacctcggaggtggangccgnaaaggtcgcacnnncagagaagctgctgccancaccanccgccccnnccctgncgggctnnataggaaactggtgaccnngctgcanaattcatacaggagcacgcgangggcacnnnctcacactgagttnnngatgangcctnaccanggacctnccccagcnnattgannacnggactgcggaggaaggaagaccccgnacnggatcctggccggcntgccacccccccacccctaggattatnccccttgactgagtctctgaggggctacccgaacccgcctccattccctaccanatnntgctcnatcgggactgacangctggggatnggaggggctatcccccancatcccctnanaccaacagcnacngannatnggggctccccngggtcggngcaacnctcctncaccccggcgcnggccttcggtgntgtcctccntcaacnaattccnaaanggcgggccccccngtggactcctcnttgttccctcc

SEQ ID NO: 38 - DNA, 687 bp, Homo sapiens
  misc_feature 3, 30, 132, 151, 203, 226, 228, 233, 252, 264, 279, 306,308, 320, 340, 347, 380, 407, 429, 437, 440, 445, 448, 491,559, 567, 586, 589, 593, 596, 603, 605, 606, 609, 626, 639,655, 674, 682: n = A,T,C or G
canaaaaaaaaaaacatggccgaaaccagnaagctgcgcgatggcgccacggcccctcttctcccggcctgtgtccggaaggtttccctccgaggcgccccggctcccgcaagcggaggagagggcgggacntgccggggccggagctcanaggccctggggccgctctgctctcccgccatcgcaagggcggcgctaacctnaggcctccccgcaaaggtccccnangcggnggcggcggggggctgtganaaccgcaaaaanaacgctgggcgcgcngcgaacccgtccacccccgcgaaggananacttccacagangcagcgtttccacagcccanagccacntttctagggtgatgcaccccagtaagttcctgncggggaagctcaccgctgtcaaaaaanctcttcgctccaccggcgcacnaagggganganggcangangctgccgcccgcacaggtcatctgatcacgtcgcccgccctantctgcttttgtgaatctccactttgttcaaccccacccgccgttctctcctccttgcgccttcctctnaccttaanaaccagcttcctctacccnatngtanttnctctgcncnngtngaaattaattcggtccnccggaacctcttncctgtggcaactgctnaaagaaactgctgttctgnttactgcngtccc

SEQ ID NO: 39 - DNA, 695 bp, Homo sapiens
  misc_feature 300, 401, 423, 429, 431, 437, 443, 448, 454, 466, 492, 515,523, 524, 536, 538, 541, 552, 561, 566, 581, 583, 619, 635,636, 641, 649, 661, 694: n = A,T,C or G
actagtctggcctacaatagtgtgattcatgtaggacttctttcatcaattcaaaacccctagaaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgaatgttaatgttaatttgttcaangttgttatgggtagaaaaaaccacatgccttaaaattttaaaaagcagggcccaaacttattagtttaaaattaggggtatgtttccagtttgttattaantggttatagctctgtttagaanaaatcnangaacangatttngaaanttaagntgacattatttnccagtgacttgttaatttgaaatcanacacggcaccttccgttttggtnctattggnntttgaatccaancnggntccaaatcttnttggaaacngtccntttaacttttttacnanatcttatttttttattttggaatggccctatttaangttaaaaggggggggnnccacnaccattcntgaataaaactnaatatatatccttggtcccccaaaatttaaggng

SEQ ID NO: 40 - DNA, 674 bp, Homo sapiens
  misc_feature 403, 428, 432, 507, 530, 543, 580, 583, 591, 604, 608, 621,624, 626, 639, 672: n = A,T,C or G
actagtagtcagttgggagtggttgctataccttgacttcatttatatgaatttccactttattaaataatagaaaagaaaatcccggtgcttgcagtagagttataggacattctatgcttacagaaaatatagccatgattgaaatcaaatagtaaaggctgttctggctttttatcttcttagctcatcttaaataagtagtacacttgggatgcagtgcgtctgaagtgctaatcagttgtaacaatagcacaaatcgaacttaggatgtgtttcttctcttctgtgtttcgattttgatcaattctttaattttgggaacctataatacagttttcctattcttggagataaaaattaaatggatcactgatatttaagtcattctgcttctcatctnaatattccatattctgtattagganaaantacctcccagcacagccccctctcaaaccccacccaaaaccaagcatttggaatgagtctcctttatttccgaantgtggatggtataacccatatcnctccaatttctgnttgggttgggtattaatttgaactgtgcatgaaaagnggnaatctttnctttgggtcaaantttnccggttaatttgnctngncaaatccaatttnctttaagggtgtctttataaaatttgctattcngg

SEQ ID NO: 41 - DNA, 657 bp, Homo sapiens
  misc_feature 243, 247, 251, 261, 267, 272, 298, 312, 315, 421, 432, 434,501, 524, 569, 594, 607, 650: n = A,T,C or G
gaaacatgcaagtaccacacactgtttgaattttgcacaaaaagtgactgtagggatcaggtgatagccccggaatgtacagtgtcttggtgcaccaagatgccttctaaaggctgacataccttgggaccctaatggggcagagagtatagccctagcccagtggtgacatgaccactccctttgggaggctgaagttaaagggaatggtatgtgttttctcatggaagcagcacatgaatnggtnacangatgttaaantaaggntctantttgggtgtcttgtcatttgaaaaantgacacactcctancanctggtaaaggggtgctggaagccatggaagaactctaaaaacattagcatgggctgatctgattacttcctggcatcccgctcacttttatgggaagtcttattanaaggatgggananttttccatatccttgctgttggaactctggaacactctctaaatttccctctattaaaaatcactgnccttactacacttcctccttganggaatagaaatggacctttctctgacttagttcttggcatggganccagcccaaattaaaatctgacttntccggtttctccngaactcacctacttgaattggtaaaacctcctttggaattagnaaaaacc

SEQ ID NO: 42 - DNA, 389 bp, Homo sapiens
  misc_feature 179, 317, 320: n = A,T,C or G
actagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagangggccttcaccgccaccagggtgtcccgccagacagggagagactccagccttctgaggccatcctgaagaattcctgtttgggggttgtgaaggaaaatcacccggatttaaaaagatgctgttgcctgcccgcgtngtngggaagggactggtttcctggtgaatttcttaaaagaaaaatattttaagttaagaaaaaaaaaaaaaa

SEQ ID NO: 43 - DNA, 279 bp, Homo sapiens
actagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaataatatgtccttatcattgtataaaagctgttatgtgcaacagtgtggagatccttgtctgatttaataaaatacttaaacactgaaaaaaaaaaaaaaaaaaa

SEQ ID NO: 44 - DNA, 449 bp, Homo sapiens
  misc_feature 245, 256, 264, 266, 273, 281, 323, 325, 337, 393: n = A,T,C or G
actagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgttgtgcaagantgggctgtttngcttggantncggtccnagtggaancatgctttcccttgttactgttggaagaaactcaaaccttcnanccctaggtgttnccattttgtcaagtcatcactgtatttttgtactggcattaacaaaaaaagaaatnaaatattgttccattaaactttaataaaactttaaaagggaaaaaaaaaaaaaaaa

SEQ ID NO: 45 - DNA, 559 bp, Homo sapiens
  misc_feature 263: n = A,T,C or G
actagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattnactagaatactttttgtgttaagttaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacagggtgaaaaaaaaattctgtgtttgcattgattatgatattctgaataaatatgggaatatattttaatgtgggtaaaaaaaaaaaaaaaaaggaa

SEQ ID NO: 46 - DNA, 731 bp, Homo sapiens
  misc_feature 270, 467, 477, 502, 635, 660, 671, 688, 695, 697, 725: n = A,T,C or G
actagttctagtaccatggctgtcatagatgcaaccattatattccatttagtttcttcctcaggttccctaacaattgtttgaaactgaatatatatgtttatgtatgtgtgtgtgttcactgtcatgtatatggtgtatatgggatgtgtgcagttttcagttatatatatattcatatatacatatgcatatatatgtataatatacatatatacatgcatacacttgtataatatacatatatatacacatatatgcacacatatnatcactgagttccaaagtgagtctttatttggggcaattgtattctctccctctgtctgctcactgggcctttgcaagacatagcaattgcttgatttcctttggataagagtcttatcttcggcactcttgactctagccttaactttagatttctattccagaatacctctcatatctatcttaaaacctaagangggtaaagangtcataagattgtagtatgaaagantttgcttagttaaattatatctcaggaaactcattcatctacaaattaaattgtaaaatgatggtttgttgtatctgaaaaaatgtttagaacaagaaatgtaactgggtacctgttatatcaaagaacctcnatttattaagtctcctcatagccanatccttatatngccctctctgacctganttaatananacttgaataatgaatagttaatttaggnttgggc

SEQ ID NO: 47 - DNA, 640 bp, Homo sapiens
  misc_feature 5, 28, 106, 153, 158, 173, 176, 182, 189, 205, 210, 214,225, 226, 229, 237, 260, 263, 269, 277, 281, 282, 322, 337,338, 354, 365, 428, 441, 443, 456, 467, 476, 484, 503, 508,554, 567, 575, 579, 588, 601, 606, 609, 611, 621, 636: n = A,T,C or G
tgcgngccggtttggcccttctttgtangacactttcatccgccctgaaatcttcccgatcgttaataactcctcaggtccctgcctgcacagggttttttcttantttgttgcctaacagtacaccaaatgtgacatcctttcaccaatatngattncttcataccacatcntcnatgganacgactncaacaattttttgatnacccnaaanactgggggctnnaanaagtacantctggagcagcatggacctgtcngcnactaanggaacaanagtnntgaacatttacacaacctttggtatgtcttactgaaaganagaaacatgcttctnnccctagaccacgaggncaaccgcaganattgccaatgccaagtccgagcggttagatcaggtaatacattccatggatgcattacatacnttgtccccgaaananaagatgccctaanggcttcttcanactggtccngaaaacanctacacctggtgcttgganaacanactctttggaagatcatctggcacaagttccccccagtgggttttnccttggcacctancttaccanatcnattcggaanccattctttgccntggcnttntnttgggaccantcttctcacaactgnaccc

SEQ ID NO: 48 - DNA, 257 bp, Homo sapiens
actagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaaaaaaaaaaaaa

SEQ ID NO: 49 - DNA, 652 bp, Homo sapiens
  misc_feature 410, 428, 496, 571, 647: n = A,T,C or G
actagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttctttaaagcagctatatcccaacccatgactttggagatatacctatnaaaccaatataacagcanggttattgaagcagctttctcaaatgttgcttcagatgtgcaagttgcaaattttattgtatttgtanaatacaatttttgttttaaactgtatttcaatctatttctccaagatgcttttcatatagagtgaaatatcccangataactgcttctgtgtcgtcgcatttgacgcataactgcacaaatgaacagtgtatacctcttggttgtgcattnacccc

SEQ ID NO: 50 - DNA, 650 bp, Homo sapiens
  misc_feature 237, 270, 311, 443, 454, 488, 520, 535, 539, 556, 567, 594,603, 634: n = A,T,C or G
ttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggttctttctagaagattgagaaatgcatatgacaggctgagancacctccccaaacacacaagctctcagccacangcagcttctccacagccccagcttcgcacaggctcctgganggctgcctgggggaggcagacatgggagtgccaaggtggccagatggttccaggactacaatgtctttatttttaactgtttgccactgctgccctcacccctgcccggctctggagtaccgtctgccccanacaagtgggantgaaatgggggtgggggggaacactgattcccanttagggggtgcctaactgaacagtagggatanaaggtgtgaacctgngaantgcttttataaattatnttccttgttanatttattttttaatttaatctctgttnaactgcccngggaaaaggggaaaaaaaaaaaaaaattctntttaaacacatgaaca

SEQ ID NO: 51 - DNA, 545 bp, Homo sapiens
  misc_feature 66, 159, 195, 205, 214, 243, 278, 298, 306, 337, 366, 375,382, 405, 446, 477, 492, 495, 503, 507, 508, 521, 537: n = A,T,C or G
tggcgtgcaaccagggtagctgaagtttgggtctgggactggagattggccattaggcctcctganattccagctcccttccaccaagcccagtcttgctacgtggcacagggcaaacctgactccctttgggcctcagtttcccctccccttcatganatgaaaagaatactactttttcttgttggtctaacnttgctggacncaaagtgtngtcattattgttgtattgggtgatgtgtncaaaactgcagaagctcactgcctatgagaggaantaagagagatagtggatganagggacanaaggagtcattatttggtatagatccacccntcccaacctttctctcctcagtccctgcncctcatgtntctggtntggtgagtcctttgtgccaccanccatcatgctttgcattgctgccatcctgggaagggggtgnatcgtctcacaacttgttgtcatcgtttganatgcatgctttcttnatnaaacaaanaaannaatgtttgacagngtttaaaataaaaaanaaacaaaa

SEQ ID NO: 52 - DNA, 678 bp, Homo sapiens
  misc_feature 98, 119, 121, 131, 136, 139, 140, 142, 143, 163, 168, 172,176, 184, 189, 190, 191, 200, 201, 205, 207, 221, 223, 229,230, 237, 240, 241, 255, 264, 266, 267, 276, 280, 288, 289,291, 297, 301, 306, 308, 314, 315, 326, 332, 335, 337: n = A,T,C or G
  misc_feature 339, 341, 343, 344, 345, 347, 350, 355, 356, 358, 362, 363,372, 379, 395, 397, 398, 400, 403, 412, 414, 421, 423, 431,435, 438, 439, 450, 457, 463, 467, 471, 474, 480, 483, 484,487, 490, 491, 492, 493, 499, 500, 504, 508, 518, 536: n = A,T,C or G
  misc_feature 538, 549, 551, 552, 554, 556, 557, 562, 563, 567, 571, 572,576, 579, 590, 592, 595, 598, 606, 609, 613, 620, 622, 624,626, 631, 634, 638, 641, 647, 654, 660, 661, 674: n = A,T,C or G
actagtagaagaactttgccgcttttgtgcctctcacaggcgcctaaagtcattgccatgggaggaagacgatttggggggggagggggggggggcanggtccgtggggctttccctantntatctccatntccantgnncnntgtcgcctcttccctcgtcncattngaanttantccctggnccccnnnccctctccnncctncncctcccccctccgncncctccnnctttttntanncttccccatctccntcccccctnanngtcccaacnccgncagcaatnncncacttnctcnctccncncctccnnccgttcttctnttctcnacntntncncnnntnccntgccnntnaaannctctccccnctgcaancgattctctccctccncnnanctntccactccntncttctcncncgctcctnttcntcnncccacctctcnccttcgnccccantacnctcnccncccttncgnntcnttnnnntcctcnnaccncccncctcccttcncccctcttctccccggtntntctctctcccncnncncnncctcnncccntccnngcgnccntttccgccccncnccnccnttccttcntcnccantccatcncntntnccatnctncctnccnctcacncccgctncccccnntctctttcacacngtcc

SEQ ID NO: 53 - DNA, 502 bp, Homo sapiens
  misc_feature 139, 146, 215, 217, 257, 263, 289, 386, 420, 452, 457, 461,466, 482, 486: n = A,T,C or G
tgaagatcctggtgtcgccatgggccgccgccccgcccgttgttaccggtattgtaagaacaagccgtacccaaagtctcgcttctgccgaggtgtccctgatgccaaaattcgcatttttgacctggggcggaaaaangcaaaantggatgagtctccgctttgtggccacatggtgtcagatcaatatgagcagctgtcctctgaagccctgnangctgcccgaatttgtgccaataagtacatggtaaaaagtngtggcnaagatgcttccatatccgggtgcggntccaccccttccacgtcatccgcatcaacaagatgttgtcctgtgctggggctgacaggctcccaacaggcatgcgaagtgcctttggaaaacccanggcactgtggccagggttcacattgggccaattnatcatgttcatccgcaccaactgcagaacaangaacntgtnaattnaagccctgcccagggncaanttcaaatttcccggcc

SEQ ID NO: 54 - DNA, 494 bp, Homo sapiens
  misc_feature 431, 442, 445: n = A,T,C or G
actagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgttaaatttttctttcagtggcaacctctataatctttaaaatatggtgagcatcttgtctgttttgaangggatatgacnatnaatctatcagatgggaaatcctgtttccaagttagaaaaaaaaaaaaaa

SEQ ID NO: 55 - DNA, 606 bp, Homo sapiens
  misc_feature 375, 395, 511, 542, 559, 569, 578, 581: n = A,T,C or G
actagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatganttttatttgcttaatattanggctttgcccttttctgttagtctcttgggatcctgtgtaaaactgttctcattaaacaccaaacagttaagtccattctctggtactagctacaaattccgtttcatattctacntaacaatttaaattaactgaaatatttctanatggtctacttctgtcntataaaaacnaaacttganttnccaaaaaaaaaaaaaaaaaaaaaaa

SEQ ID NO: 56 - DNA, 183 bp, Homo sapiens
actagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaataaaaaaaaaaaaaaaaaaaa

SEQ ID NO: 57 - DNA, 622 bp, Homo sapiens
  misc_feature 358, 368, 412, 414, 425, 430, 453, 455, 469, 475, 495, 499,529, 540, 564, 575, 590: n = A,T,C or G
actagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttagggatcttctgagcttgtttccctgctgggtgggacagaagacaaaggagaaggganggtctacaanaagcagcccttctttgtcctctggggttaatgagcttgacctananttcatggaganaccanaagcctctgatttttaatttccntnaaatgtttgaagtntatatntacatatatatatttctttnaatntttgagtctttgatatgtcttaaaatccantccctctgccngaaacctgaattaaaaccatgaanaaaaatgtttnccttaaagatgttantaattaattgaaacttgaaaaaaaaaaaaaaa

SEQ ID NO: 58 - DNA, 433 bp, Homo sapiens
gaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgaaaaaaaaaaaaaaaaaa

SEQ ID NO: 59 - DNA, 649 bp, Homo sapiens
  misc_feature 22, 190, 217, 430, 433, 484, 544, 550, 577, 583, 594: n = A,T,C or G
actagttattatctgactttcnggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtntgtctttttattactgagttgtaaganttctttatatattctggattctagacccttatcagatacatggtttgcaaatattttctcccattctgtgggttgtgttttcactttatcgataatgtccttagacatataataaatttgtattttaaaagtgacttgatttgggctgtgcaaggtgggctcacgcttgtaatcccagcactttgggagactgaggtgggtggatcatatgangangctaggagttcgaggtcagcctggccagcatagcgaaaacttgtctctacnaaaaatacaaaaattagtcaggcatggtggtgcacgtctgtaataccagcttctcaggangctgangcacaaggatcacttgaaccccagaangaagangttgcagtganctgaagatcatgccagggcaacaaaaatgagaacttgtttaaaaaaaaaaaaaaa

SEQ ID NO: 60 - DNA, 423 bp, Homo sapiens
  misc_feature 209, 222, 277, 389, 398: n = A,T,C or G
actagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtanaacacaagactcngattcagccgaattgtggtgtcttacaaggcagggctttcctacagggggtgganaaaacagcctttcttcctttggtaggaatggcctgagttggcgttgtgggcaggctactggtttgtatgatgtattagtagagcaacccattaatcttttgtagtttgtatnaaacttganctgagaccttaaacaaaaaaaaaaa

SEQ ID NO: 61 - DNA, 423 bp, Homo sapiens
  misc_feature 195, 285, 295, 329, 335, 340, 347, 367, 382, 383, 391, 396,418: n = A,T,C or G
cgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagaagactggatcagggtanctacaagtggccgggccttgcctttgggattctaccctgttcctaatttggtgttggggtgcggggtccctggcccccttttccacactncctccctccngacagcaacctcccttggggcaattgggcctggntctccncccgntgttgcnaccctttgttggtttaaggnctttaaaaatgttannttttcccntgccngggttaaaaaaggaaaaaactnaaaaa

SEQ ID NO: 62 - DNA, 683 bp, Homo sapiens
  misc_feature 218, 291, 305, 411, 416, 441, 443, 453, 522, 523, 536, 542,547, 566, 588, 592, 595, 603, 621, 628, 630, 632, 644, 645,648, 655, 660, 672, 674, 676, 677, 683: n = A,T,C or G
gctggagaggggtacggactttcttggagttgtcccaggttggaatgagactgaactcaagaagagaccctaagagactggggaatggttcctgccttcaggaaagtgaaagacgcttaggctgtcaacacttaaaggaagtccccttgaagcccagagtggacagactagacccattgatggggccactggccatggtccgtggacaagacattccngtgggccatggcacaccgggggggatcaaaatgtgtacttgtggggtctcgccccttgccaaaaccaaaccantcccactcctgtcnttggactttcttcccattccctcctccccaaatgcacttcccctcctccctctgcccctcctgtgtttttggaattctgtttccctcaaaattgttaattttttanttttngaccatgaacttatgtttggggtcnangttccccttnccaatgcatactaatatattaatggttatttatttttgaaatattttttaatgaacttggaaaaaattnntggaatttccttncttccnttttntttggggggggtggggggntgggttaaaatttttttggaancccnatnggaaattnttacttggggcccccctnaaaaaantnanttccaattcttnnatngcccctnttccnctaaaaaaaaananannaaaaan

SEQ ID NO: 63 - DNA, 731 bp, Homo sapiens
  misc_feature 237, 249, 263, 288, 312, 317, 323, 326, 337, 352, 362, 370,377, 400, 411, 414, 434, 436, 446, 457, 473, 486, 497, 498,502, 512, 531, 546, 554, 563, 565, 566, 588, 597, 608, 611,613, 615, 627, 632, 640, 641, 644, 654, 660, 663, 665: n = A,T,C or G
  misc_feature 671, 678, 692, 697, 698, 699, 704, 705, 712, 714, 717, 718,719, 723, 725, 730, 731: n = A,T,C or G
actagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagaccgcgagctcaccgcatgcccttcttggaggccgcgggccacaagcttggcgcccanaaagaaggcgtngggggcccgcaaantaccacgctctgggcgctatggaangtcctcttgcaataatattggttnaaaanctgcanaanagcccctgcanccccctgaactgggntgcagggccncttacctngtttggntgcggttacaaagaacctgtttnggaaaaccctnccnaaaaccttccgggaaaattntncaaatttttnttggggaattnttgggtaaaccccccnaaaatgggaaacntttttgccctnnaaantaaaccattnggttccgggggcccccccncaaaacccttttttntttttttntgcccccantnnccccccggggcccctttttttnggggaaaanccccccccctnccnananttttaaaagggnggganaatttttnnttnccccccgggncccccnggngntaaaanggtttcncccccccgaggggnggggnnncctcnnaaacccntntcnnnaccncnttttnn

SEQ ID NO: 64 - DNA, 313 bp, Homo sapiens
  misc_feature 240: n = A,T,C or G
actagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagatnaaatgttgatcatgtatatatatccatagtgaataaaattgtctcagtaaagttgtaaaaaaaaaaaaaaaaa

SEQ ID NO: 65 - DNA, 420 bp, Homo sapiens
  misc_feature 400, 402, 403, 404, 405, 406, 409, 411, 412, 414, 415, 416: n = A,T,C or G
actagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccaagccaggtttctccgtgctcactaatttatttccaggaaaggtgtgtggaagacatgagccgtgtataatatttgttttaacattttcattgcaagtattgaccatcatccttggttgtgtatcgttgtaacacaaattaatgatattaaaaagcatccaaacaaagccnannnnnaanannannngaaa

SEQ ID NO: 66 - DNA, 676 bp, Homo sapiens
  misc_feature 328, 454, 505, 555, 586, 612, 636, 641: n = A,T,C or G
actagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttccgagggaagtagtttttaaatgtgagcttatagatnggaaacagaatatcaacttaattatggaaattgttagaaacctgttctcttgttatctgaatcttgattgcaattactattgtactggatagactccagcccattgcaaagtctcagatatcttanctgtgtagttgaattccttggaaattctttttaagaaaaaattggagtttnaaagaaataaacccctttgttaaatgaagcttggctttttggtgaaaaanaatcatcccgcagggcttattgtttaaaaanggaattttaagcctccctggaaaaanttgttaattaaatggggaaaatgntgggnaaaaattatccgttagggtttaaagggaaaactta

SEQ ID NO: 67 - DNA, 620 bp, Homo sapiens
  misc_feature 419, 493, 519, 568, 605, 610: n = A,T,C or G
caccattaaagctgcttaccaagaacttccccagcattttgacttccttgtttgatagctgaattgtgagcaggtgatagaagagcctttctagttgaacatacagataatttgctgaatacattccatttaatgaaggggttacatctgttacgaagctactaagaaggagcaagagcataggggaaaaaaatctgatcagaacgcatcaaactcacatgtgccccctctactacaaacagattgtagtgctgtggtggtttattccgttgtgcagaacttgcaagctgagtcactaaacccaaagagaggaaattataggttagttaaacattgtaatcccaggaactaagtttaattcacttttgaagtgttttgttttttatttttggtttgtctgatttactttgggggaaaangctaaaaaaaaagggatatcaatctctaattcagtgcccactaaaagttgtccctaaaaagtctttactggaanttatgggactttttaagctccaggtnttttggtcctccaaattaaccttgcatgggccccttaaaattgttgaanggcattcctgcctctaagtttggggaaaattcccccnttttnaaaatttgga

SEQ ID NO: 68 - DNA, 551 bp, Homo sapiens
  misc_feature 286, 464, 480, 501, 502, 518, 528, 533, 536, 537, 538, 539,540, 541, 543, 544, 545, 547, 548, 549: n = A,T,C or G
actagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtangtgctctgggagggactcggcaccactttgatattcaacaagccacttgaagcccaattataaaattgttattttacagctgatggaactcaatttgaaccttcaaaactttgttagtttatcctattatattgttaaacctaattacatttgtctagcattggatttggttcctgtngcatatgtttttttcncctatgtgctcccctcccccnnatcttaatttaaaccncaattttgcnattcnccnnnnnnannnannnaa

SEQ ID NO: 69 - DNA, 396 bp, Homo sapiens
  misc_feature 235, 310, 323, 381: n = A,T,C or G
cagaaatggaaagcagagttttcatttctgtttataaacgtctccaaacaaaaatggaaagcagagttttcattaaatccttttaccttttttttttcttggtaatcccctcaaataacagtatgtgggatattgaatgttaaagggatatttttttctattatttttataattgtacaaaattaagcaaatgttaaaagttttatatgctttattaatgttttcaaaaggtatnatacatgtgatacattttttaagcttcagttgcttgtcttctggtactttctgttatgggcttttggggagccanaaaccaatctacnatctctttttgtttgccaggacatgcaataaaatttaaaaaataaataaaaactattnagaaattgaaaaaaa

SEQ ID NO: 70 - DNA, 536 bp, Homo sapiens
  misc_feature 388, 446, 455: n = A,T,C or G
actagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgacttcatttttaaatgntacttgctcagctcaactgcatttcagttgttttatagtccagttcttatcaacattnaaacctatngcaatcatttcaaatctattctgcaaattgtataagaataaaagttagaatttaacaattaaaaaaaaaaaaaaaaaaaaa

SEQ ID NO: 71 - DNA, 865 bp, Homo sapiens
  misc_feature 22, 35, 39, 56, 131, 138, 146, 183, 194, 197, 238, 269, 277,282, 297, 316, 331, 336, 340, 341, 346, 349, 370, 376, 381,382, 392, 396, 397, 401, 433, 444, 445, 454, 455, 469, 472,477, 480, 482, 489, 497, 499, 511, 522, 526, 527: n = A,T,C or G
  misc_feature 545, 553, 556, 567, 574, 580, 610, 613, 634, 638, 639, 663,672, 689, 693, 694, 701, 704, 713, 723, 729, 732, 743, 744,749, 761, 765, 767, 769, 772, 774, 780, 783, 788, 792, 803,810, 824, 840, 848: n = A,T,C or G
gacaaagcgttaggagaagaanagaggcagggaanactncccaggcacgatggccnccttcccaccagcaaccagcgccccccaccagcccccaggcccggacgacgaagactccatcctggattaatctnacctctntcgcctgncccattcctacctcggaggtggaggccggaaaggtcncaccaagaganaanctgctgccaacaccaaccgccccagccctggcgggcacganaggaaactggtgaccaatctgcagaattctnagaggaanaagcnaggggccccgcgctnagacagagctggatatgangccagaccatggacnctacncccnncaatncanacgggactgcggaagatggangacccncgacnngatcaggccngctnnccanccccccacccctatgaattattcccgctgaangaatctctgannggcttccannaaagcgcctccccnccnaacgnaantncaacatngggattanangctgggaactgnaaggggcaaancctnnaatatccccagaaacaanctctcccnaanaaactggggcncctcatnggtggnaccaactattaactaaaccgcacgccaagnaantataaaaggggggcccctccncggnngacccccttttgtcccttaatganggttatccnccttgcgtaccatggtncccnnttctgtntgnatgtttccnctcccctccncctatntcnagccgaactcnnatttncccgggggtgcnatcnantngtncncctttnttngttgncccngccctttccgncggaacncgtttccccgttantaacggcacccggggnaagggtgnttggccccctccctccc

SEQ ID NO: 72 - DNA, 560 bp, Homo sapiens
  misc_feature 83, 173, 183, 186, 209, 211, 215, 255, 321, 322, 323, 335,344, 357, 361, 368, 394, 412, 415, 442, 455, 469, 472, 475,487, 513, 522, 528, 531, 534, 546: n = A,T,C or G
cctggacttgtcttggttccagaacctgacgacccggcgacggcgacgtctcttttgactaaaagacagtgtccagtgctccngcctaggagtctacggggaccgcctcccgcgccgccaccatgcccaacttctctggcaactggaaaatcatccgatcggaaaacttcgangaattgctcnaantgctgggggtgaatgtgatgctnangaanattgctgtggctgcagcgtccaagccagcagtggagatcnaacaggagggagacactttctacatcaaaacctccaccaccgtgcgcaccacaaagattaacttcnnngttggggaggantttgaggancaaactgtggatnggangcctgtnaaaacctggtgaaatgggagaatganaataaaatggtctgtgancanaaactcctgaaaggagaaggcccccanaactcctggaccngaaaaactgacccnccnatnggggaactgatncttgaaccctgaacgggcgggatganccttttttnttgccnccnaangggttctttccntttccccaaaaaaa

SEQ ID NO: 73 - DNA, 379 bp, Homo sapiens
  misc_feature 8, 17, 18, 21, 26, 29, 30, 32, 53, 56, 67, 71, 81, 102, 104,111, 112, 114, 119, 122, 124, 125, 134, 144, 146, 189, 190,214, 215, 219, 220, 235, 237, 246, 280, 288, 302, 310, 313,319, 322, 343, 353, 354: n = A,T,C or G
ctgggganccggcggtnngcnccatntcnngncgcgaaggtggcaataaaaanccnctgaaaccgcncaanaaacatgccnaagatatggacgaggaagatngngctttcnngnacaancgnanngaggaacanaacaaactcnangagctctcaagctaatgccgcggggaaggggcccttggccacnngtggaattaagaaatctggcaaanngtanntgttccttgtgcctnangagataagngaccctttatttcatctgtatttaaacctctctnttccctgncataacttcttttnccacgtanagntggaantanttgttgtcttggactgttgtncattttagannaaacttttgttcaaaaaaaaaataa

SEQ ID NO: 74 - DNA, 437 bp, Homo sapiens
  misc_feature 145, 355: n = A,T,C or G
actagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttanaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctnattgtgtcatttgtactgtttgaaaaatatttcttctataaaattaaactaacctgccttaaaaaaaaaaaaaaaaaaaaaa

SEQ ID NO: 75 - DNA, 579 bp, Homo sapiens
  misc_feature 440, 513, 539, 551: n = A,T,C or G
ctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgcccttggggtggaaggggcangatctgcactgcttttgcatttctcttcctaaatttcattgtgttgattctttccttccaataggtgatcttnattactttcagaatattttccaaatnagatatattttnaaaatccttaaaaaaaaaaaaaaaaaaa

SEQ ID NO: 76 - DNA, 666 bp, Homo sapiens
  misc_feature 411, 470, 476, 491, 506, 527, 560, 570, 632, 636, 643, 650,654, 658: n = A,T,C or G
gtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataaaaagcacgtggtaaaacacttgcggatattctggactgtttttaaaaaatatacagtttaccgaaaatcatattatcttacaatgaaaaggantttatagatcagccagtgaacaaccttttcccaccatacaaaaattccttttcccgaangaaaanggctttctcaataancctcactttcttaanatcttacaagatagccccganatcttatcgaaactcattttaggcaaatatganttttattgtncgttacttgtttcaaaatttggtattgtgaatatcaattaccacccccatctcccatgaaanaaangggaaanggtgaanttcntaancgcttaaa

SEQ ID NO: 77 - DNA, 396 bp, Homo sapiens
  misc_feature 31, 54, 125, 128, 136, 163, 168, 198: n = A,T,C or G
ctgcagcccgggggatccactaatctaccanggttatttggcagctaattctanatttggatcattgcccaaagttgcacttgctggtctcttgggatttggccttggaaaggtatcatacatangantatgccanaataaattccatttttttgaaaatcanctccntggggctggttttggtccacagcataacangcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatgggaacaaaaaaaaaaaaaaaaaa

SEQ ID NO: 78 - DNA, 793 bp, Homo sapiens
  misc_feature 309, 492, 563, 657, 660, 703, 708, 710, 711, 732, 740, 748,758, 762, 765, 787: n = A,T,C or G
gcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcnagctttaaagaaagtgtttgctgaaaataaagaaatccagaaattggcagagcagtttgtcctcctcaatctggtttatgaaacaactgacaaacacctttctcctgatggccagtatgtcccaggattatgtttgttgacccatctctgacagttgaagccgatatcctgggaagatattcnaaccgtctctatgcttacaaactgcagatacgctctgttgcttgacacatgaaaaagctctcaagttgctnaaaatgaattgtaagaaaaaaaatctccagccttctgtctgtcggcttgaaaattgaaaccagaaaaatgtgaaaaatggctattgtggaacanatngacacctgattaggttttggttatgttcaccactatttttaanaaaanannttttaaaatttggttcaattntctttttnaaacaatntgtttctacnttgnganctgatttctaaaaaaaataatntttggc

SEQ ID NO: 79 - DNA, 456 bp, Homo sapiens
  misc_feature 89, 195, 255, 263, 266, 286, 353, 384, 423, 425, 436, 441: n = A,T,C or G
actagtatggggtgggaggccccacccttctcccctaggcgctgttcttgctccaaagggctccgtggagagggactggcagagctgangccacctggggctggggatcccactcttcttgcagctgttgagcgcacctaaccactggtcatgcccccacccctgctctccgcacccgcttcctcccgaccccangaccaggctacttctcccctcctcttgcctccctcctgcccctgctgcctctgatcgtangaattgangantgtcccgccttgtggctganaatggacagtggcaggggctggaaatgggtgtgtgtgtgtgtgtgtgtgtgtgtgtgtgtgtgtgcnccccccctgcaagaccgagattgagggaaancatgtctgctgggtgtgaccatgtttcctctccataaantncccctgtgacnctcanaaaaaaaaaaaaaaa

SEQ ID NO: 80 - DNA, 284 bp, Homo sapiens
  misc_feature 283: n = A,T,C or G
ctttgtacctctagaaaagataggtattgtgtcatgaaacttgagtttaaattttatatataaaactaaaagtaatgctcactttagcaacacatactaaaattggaaccatactgagaagaatagcatgacctccgtgcaaacaggacaagcaaatttgtgatgtgttgattaaaaagaaataaataaatgtgtatatgtgtaacttgtatgtttatgtggaatacagattgggaaataaaatgtatttcttactgtgaaaaaaaaaaaaaaaaaaaaaaana

SEQ ID NO: 81 - DNA, 671 bp, Homo sapiens
  misc_feature 388, 505, 600, 603, 615, 642, 644, 660: n = A,T,C or G
gccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatnattttgcactttgagattaaaatgccatgtctatttgattagtcttatttttttatttttacaggcttatcagtctcactgttggctgtcattgtgacaaagtcaaataaacccccnaggacaacacacagtatgggatcacatattgtttgacattaagctttggccaaaaaatgttgcatgtgttttacctcgacttgctaaatcaatancanaaaggctggctnataatgttggtggtgaaataattaatnantaaccaaaaaaaaaanaaaaaaaaaaa

SEQ ID NO: 82 - DNA, 217 bp, Homo sapiens
  misc_feature 35: n = A,T,C or G
ctgcagatgtttcttgaatgctttgtcaaattaanaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggaaaaaaaaaaaaaaaaaaaaaa

SEQ ID NO: 83 - DNA, 460 bp, Homo sapiens
  misc_feature 104, 118, 172, 401, 422, 423, 444, 449: n = A,T,C or G
cgcgagtgggagcaccaggatctcgggctcggaacgagactgcacggattgttttaagaaaatggcagacaaaccagacatgggggaaatcgccagcttcgatnaggccaagctgaanaaaacggagacgcaggagaagaacaccctgccgaccaaagagaccattgagcangagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggaccccccccaatcggactgccaaattctccggtttgccccgggatattatacaanattatttgtatgaataatgannataaaacacacctcgtggcancaaanaaaaaaaaaaa

SEQ ID NO: 84 - DNA, 323 bp, Homo sapiens
  misc_feature 70, 138, 178, 197, 228, 242, 244, 287, 311: n = A,T,C or G
tggtggatcttggctctgtggagctgctgggacgggatctaaaagactattctggaagctgtggtccaangcattttgctggcttaacgggtcccggaacaaaggacaccagctctctaaaattgaagtttacccganataacaatcttttgggcagagatgcctattttaacaaacnccgtccctgcgcaacaacnaacaatctctgggaaataccggccatgaacntgctgtctcaatcnancatctctctagctgaccgatcatatcgtcccagattactacanatcataataattgatttcctgtanaaaaaaaaaaaa

SEQ ID NO: 85 - DNA, 771 bp, Homo sapiens
  misc_feature 63, 426, 471, 497, 521, 554, 583, 586, 606, 609, 615, 652,686, 691, 694, 695, 706, 713, 730, 732, 743, 751: n = A,T,C or G
aaactgggtactcaacactgagcagatctgttctttgagctaaaaaccatgtgctgtaccaanagtttgctcctggctgctttgatgtcagtgctgctactccacctctgcggcgaatcagaagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaacttgctggggttggaggtttcacttgcacatcatgganggtttagtgcttatcttatttgtgcctcctggacttgtccaattnatgaagttaatcatattgcatcatantttgctttgtttaacatcacattnaaattaaactgtattttatgttatttatagctntaggttttctgtgtttaactttttatacnaantttcctaaactattttggtntantgcaanttaaaaattatatttggggggggaataaatattggantttctgcagccacaagctttttttaaaaaaccantacanccnngttaaatggtnggtcccnaatggtttttgcttttnantagaaaatttnttagaacnatttgaaaaaaaaaaaaaaa

SEQ ID NO: 86 - DNA, 628 bp, Homo sapiens
  misc_feature 162, 249, 266, 348, 407, 427, 488, 518, 545, 566, 569, 597,598, 611, 617, 621, 624: n = A,T,C or G
actagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaaaangactttattgttcattgtagttcatacattcaaagcatctgaactgtagtttctatagcaagccaattacatccataagtggagaangaaatagattaatgtcnaagtatgattggtggagggagcaaggttgaagataatctggggttgaaattttctagttttcattctgtacatttttagttngacatcagatttgaaatattaatgtttacctttcaatgtgtggtatcagctggactcantaacacccctttcttccctnggggatggggaatggattattggaaaatggaaagaaaaaagtacttaaagccttcctttcncagtttctggctcctaccctactgatttanccagaataagaaaacattttatcatcntctgctttattcccattaatnaanttttgatgaataaatctgcttttatgcnnacccaaggaattnagtggnttcntcnttgt

SEQ ID NO: 87 - DNA, 518 bp, Homo sapiens
  misc_feature 384, 421, 486: n = A,T,C or G
ttttttattttttttagagagtagttcagcttttatttataaatttattgcctgttttattataacaacattatactgtttatggtttaatacatatggttcaaaatgtataatacatcaagtagtacagttttaaaattttatgcttaaaacaagttttgtgtaaaaaatgcagatacattttacatggcaaatcaatttttaagtcatcctaaaaattgatttttttttgaaatttaaaaacacatttaatttcaatttctctcttatataacctttattactatagcatggtttccactacagtttaacaatgcagcaaaattcccatttcacggtaaattgggttttaagcggcaaggttaaaatgctttgaggatcctnaataccctttgaacttcaaatgaaggttatggttgtnaatttaaccctcatgccataagcagaagcacaagtttagctgcattttgctctaaactgtaaaancgagccccccgttgaaaaagcaaaagggaccc

SEQ ID NO: 88 - DNA, 1844 bp, Homo sapiens
gagacagtgaatcctagtatcaaaggatttttggcctcagaaaaagttgttgattatttttattttattttatttttcgagactccgtctcaaaaaaaaaaaaaaaaaaaagaatcacaaggtatttgctaaagcattttgagctgcttggaaaaagggaagtagttgcagtagagtttcttccatcttcttggtgctgggaagccatatatgtgtcttttactcaagctaaggggtataagcttatgtgttgaatttgctacatctatatttcacatattctcacaataagagaattttgaaatagaaatatcatagaacatttaagaaagtttagtataaataatattttgtgtgttttaatccctttgaagggatctatccaaagaaaatattttacactgagctccttcctacacgtctcagtaacagatcctgtgttagtctttgaaaatagctcattttttaaatgtcagtgagtagatgtagcatacatatgatgtataatgacgtgtattatgttaacaatgtctgcagattttgtaggaatacaaaacatggccttttttataagcaaaacgggccaatgactagaataacacatagggcaatctgtgaatatgtattataagcagcattccagaaaagtagttggtgaaataattttcaagtcaaaaagggatatggaaagggaattatgagtaacctctattttttaagccttgcttttaaattaaacgctacagccatttaagccttgaggataataaagcttgagagtaataatgttaggttagcaaaggtttagatgtatcacttcatgcatgctaccatgatagtaatgcagctcttcgagtcatttctggtcattcaagatattcacccttttgcccatagaaagcaccctacctcacctgcttactgacattgtcttagctgatcacaagatcattatcagcctccattattccttactgtatataaaatacagagttttatattttcctttcttcgtttttcaccatattcaaaacctaaatttgtttttgcagatggaatgcaaagtaatcaagtgttcgtgctttcacctagaagggtgtggtcctgaaggaaagaggtccctaaatatcccccaccctgggtgctcctccttccctggtaccctgactaccagaagtcaggtgctagagcagctggagaagtgcagcagcctgtgcttccacagatgggggtgctgctgcaacaaggctttcaatgtgcccatcttagggggagaagctagatcctgtgcagcagcctggtaagtcctgaggaggttccattgctcttcctgctgctgtcctttgcttctcaacggggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgacttaaaaattgatttgccatgtaaaatgtatctgcattttttacacaaaacttgttttaagcataaaattttaaaactgtactacttgatgtattatacattttgaaccatatgtattaaaccataaacagtataatgttgttataataaaacaggcaataaatttataaataaaagctgaaaaaaaaaaaaaaaaaaaaaaaa

SEQ ID NO: 89 - DNA, 523 bp, Homo sapiens
  misc_feature 288, 352, 369, 398, 475, 511, 513: n = A,T,C or G
tttttttttttttttttagtcaatccacatttattgatcacttattatgtaccaggcactgggataaagatgactgttagtcactcacagtaaggaagaaaactagcaaataagacgattacaatatgatgtagaaaatgctaagccagagatatagaaaggtcctattgggtccttctgtcaccttgtctttccacatccctacccttcacaggccttccctccagcttcctgcccccgctccccactgcagatcccctgggattttgcctagagctaaacgagganatgggccccctggccctggcatgacttgaacccaaccacagactgggaaagggagcctttcganagtggatcactttgatnagaaaacacatagggaattgaagagaaantccccaaatggccacccgtgctggtgctcaagaaaagtttgcagaatggataaatgaaggatcaagggaattaatanatgaataattgaatggtggctcaataagaatgactncnttgaatgacc

SEQ ID NO: 90 - DNA, 604 bp, Homo sapiens
  misc_feature 563: n = A,T,C or G
ccagtgtggtggaatgcaaagattaccccggaagctttcgagaagctgggattccctgcagcaaaggaaatagccaatatgtgtcgtttctatgaaatgaagccagaccgagatgtcaatctcacccaccaactaaatcccaaagtcaaaagcttcagccagtttatctcagagaaccaggggagccttcaagggcatgtagaaaatcagctgttcagataggcctctgcaccacacagcctctttcctctctgatccttttcctctttacggcacaacattcatgtttgacagaacatgctggaatgcaattgtttgcaacaccgaaggatttcctgcggtcgcctcttcagtaggaagcactgcattggtgataggacacggtaatttgattcacatttaacttgctagttagtgataaggggtggtacacctgtttggtaaaatgagaagcctcggaaacttgggagcttctctcctaccactaatggggagggcagattattactgggatttctcctggggtgaattaatttcaagccctaattgctgaaattcccctnggcaggctccagttttctcaactgcattgcaaaattccccc

SEQ ID NO: 91 - DNA, 858 bp, Homo sapiens
  misc_feature 570, 591, 655, 664, 667, 683, 711, 759, 760, 765, 777, 787,792, 794, 801, 804, 809, 817, 820: n = A,T,C or G
tttttttttttttttttttatgattattattttttttattgatctttacatcctcagtgttggcagagtttctgatgcttaataaacatttgttctgatcagataagtggaaaaaattgtcatttccttattcaagccatgcttttctgtgatattctgatcctagttgaacatacagaaataaatgtctaaaacagcacctcgattctcgtctataacaggactaagttcactgtgatcttaaataagcttggctaaaatgggacatgagtggaggtagtcacacttcagcgaagaaagagaatctcctgtataatctcaccaggagattcaacgaattccaccacactggactagtggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaanagcccgcaccgatcgcccttncaacagttgcgcagcctgaatggcgaatgggacgcgccctgtagcggcgcattaaagcgcggcngggtgtggnggntcccccacgtgaccgntacacttggcagcgccttacgccggtcnttcgctttcttcccttcctttctcgcaccgttcgccgggtttccccgnnagctnttaatcgggggnctccctttangggtncnaattaanggnttacnggaccttngancccaaaaactttgattagggggaaggtccccgaagggg

SEQ ID NO: 92 - DNA, 585 bp, Homo sapiens
  misc_feature 317, 319, 320, 321, 325, 327, 328, 330, 331, 332, 460, 462,483, 485, 487, 523, 538, 566, 584: n = A,T,C or G
gttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcatnannnaaanannannngaagggcggccgccaccgcggtggagctccagcttttgttccctttagtgagggttaattgcgcgcttggcgttaatcatggtcatagctgtttcctgtgtgaaattgttatccggctcacaattccncncaacatacgagccgggaagcntnangtgtaaaagcctgggggtgcctaattgagtgagctnactcacattaattgngttgcgctccacttgcccgcttttccantccgggaaacctgttcgnc

SEQ ID NO: 93 - DNA, 567 bp, Homo sapiens
  misc_feature 82, 158, 230, 232, 253, 266, 267, 268, 269, 270, 271, 272,273, 274, 275, 276, 277, 278, 279, 280, 281, 282, 283, 284,285, 286, 287, 295, 303, 307, 314, 349, 352, 354, 356, 366,369, 379, 382, 386, 393, 404, 427, 428, 446, 450, 452: n = A,T,C or G
  misc_feature 453, 454, 459, 462, 480, 481, 483, 488, 493, 501, 509, 511,512, 518, 520, 525, 526, 532, 541, 557: n = A,T,C or G
cggcagtgttgctgtctgcgtgtccaccttggaatctggctgaactggctgggaggaccaagactgcggctggggtgggcanggaagggaaccgggggctgctgtgaaggatcttggaacttccctgtacccaccttccccttgcttcatgtttgtanaggaaccttgtgccggccaagcccagtttccttgtgtgatacactaatgtatttgctttttttgggaaatananaaaaatcaattaaattgctantgtttctttgaannnnnnnnnnnnnnnnnnnnnngggggggncgcccccncggnggaaacncccccttttgttccctttaattgaaaggttaattngcncncntggcgttaanccntgggccaaanctngttncccgtgntgaaattgttnatcccctcccaaattcccccccnnccttccaaacccggaaancctnannntgttnaancccggggggttgcctaanngnaattnaaccnaacccccntttaaatngnntttgcncnccacnngccccnctttcccanttcggggaaaaccctntccgtgccca

SEQ ID NO: 94 - DNA, 620 bp, Homo sapiens
  misc_feature 169, 171, 222, 472, 528, 559, 599: n = A,T,C or G
actagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaananaatatgcacgtgaaacttaacactttataaggtaaaaatgaggtttccaanatttaataatctgatcaagttcttgttatttccaaatagaatggacttggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcactaaggctcatgttnactccgatatgtctctaagaaagtactatttcatggtccaaacctggttgccatanttgggtaaaggctttcccttaagtgtgaaantatttaaaatgaaattttcctctttttaaaaattctttanaagggttaagggtgttgggga

SEQ ID NO: 95 - DNA, 470 bp, Homo sapiens
  misc_feature 61, 67, 79, 89, 106, 213, 271, 281, 330, 354, 387, 432, 448: n = A,T,C or G
ctcgaccttctctgcacagcggatgaaccctgagcagctgaagaccagaaaagccactatnactttntgcttaattcangagcttacangattcttcaaagagtgngtccagcatcctttgaaacatgagttcttaccagcagaagcagacctttaccccaccacctcagcttcaacagcagcaggtgaaacaacccatccagcctccacctnaggaaatatttgttcccacaaccaaggagccatgccactcaaaggttccacaacctgnaaacacaaanattccagagccaggctgtaccaaggtccctgagccagggctgtaccaangtccctgagccaggttgtaccaangtccctgagccaggatgtaccaaggtccctganccaggttgtccaaggtccctgagccaggctacaccaagggcctgngccaggcagcatcaangtccctgaccaaggcttatcaa

SEQ ID NO: 96 - DNA, 660 bp, Homo sapiens
  misc_feature 299, 311, 360, 426, 538, 540, 542, 553, 563, 565, 592, 603,604, 618, 633, 647, 649, 651, 653: n = A,T,C or G
ttttttttttttttttttttggaattaaaagcaatttaatgagggcagagcaggaaacatgcatttcttttcattcgaatcttcagatgaaccctgagcagccgaagaccagaaaagccatgaagactttctgcttaattcaggggcttacaggattcttcagagtgtgtgtgaacaaaagctttatagtacgtatttttaggatacaaataagagagagactatggcttggggtgagaatgtactgattacaaggtctacagacaattaagacacagaaacagatgggaagagggtgnccagcatctggnggttggcttctcaagggcttgtctgtgcaccaaattacttctgcttggncttctgctgagctgggcctggagtgaccgttgaaggacatggctctggtacctttgtgtagcctgncacaggaactttggtgtatccttgctcaggaactttgatggcacctggctcaggaaacttgatgaagccttggtcaagggaccttgatgcttgctggctcagggaccttggngnancctgggctcanggacctttgncncaaccttggcttcaagggacccttggnacatcctggcnnagggacccttgggnccaaccctgggcttnagggaccctttggntncnanccttggc

SEQ ID NO: 97 - DNA, 441 bp, Homo sapiens
  misc_feature 12, 308: n = A,T,C or G
gggaccatacanagtattcctctcttcacaccaggaccagccactgttgcagcatgagttcccagcagcagaagcagccctgcatcccaccccctcagcttcagcagcagcaggtgaaacagccttgccagcctccacctcaggaaccatgcatccccaaaaccaaggagccctgccaccccaaggtgcctgagccctgccaccccaaagtgcctgagccctgccagcccaaggttccagagccatgccaccccaaggtgcctgagccctgcccttcaatagtcactccagcaccagcccagcagaanaccaagcagaagtaatgtggtccacagccatgcccttgaggagccggccaccagatgctgaatcccctatcccattctgtgtatgagtcccatttgccttgcaattagcattctgtctcccccaaaaaaaaaa

SEQ ID NO: 98 - DNA, 600 bp, Homo sapiens
  misc_feature 295, 349, 489, 496, 583: n = A,T,C or G
gtattcctctcttcacaccaggaccagccactgttgcagcatgagttcccagcagcagaagcagccctgcatcccaccccctcagcttcagcagcagcaggtgaaacagccttgccagcctccacctcaggaaccatgcatccccaaaaccaaggagccctgccaccccaaggtgcctgagccctgccaccccaaagtgcctgagccctgccagcccaaggttccagagccatgccaccccaaggtgcctgagccctgcccttcaatagtcactccagcaccagcccagcagaanaccaagcagaagtaatgtggtccacagccatgcccttgaggagccggccaccanatgctgaatcccctatcccattctgtgtatgagtcccatttgccttgcaattagcattctgtctcccccaaaaaagaatgtgctatgaagctttctttcctacacactctgagtctctgaatgaagctgaaggtcttaantacaganctagttttcagctgctcagaattctctgaagaaaagatttaagatgaaaggcaaatgattcagctccttattaccccattaaattcnctttcaattccaaaaaa

SEQ ID NO: 99 - DNA, 667 bp, Homo sapiens
  misc_feature 345, 562, 635: n = A,T,C or G
actagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttnatatttttgatttacattttgtaaggctataattgtatcttttaagaaaacataccttggatttctatgttgaaatggagatttttaagagttttaaccagctgctgcagatatattactcaaaacagatatagcgtataaagatatagtaaatgcatctcctagagtaatattcacttaacacattggaaactattattttttagatttgaatatnaatgttattttttaaacacttgttatgagttacttgggattacattttgaaatcagttcattccatgatgcanattactgggattagattaagaaagacggaaaa

SEQ ID NO: 100 - DNA, 583 bp, Homo sapiens
  misc_feature 404, 506, 514, 527, 528, 538, 548, 556, 568, 569: n = A,T,C or G
gttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaaattaaaattgctaaaatcatggactggctttctggttggatttcaggtaagatgtgtttaaggccagagcttttctcagtatttgatttttttccccaatatttgattttttaaaaatatacacatnggtgctgcatttatatctgctggtttaaaattctgtcatatttcacttctagccttttagttatggcaaatcatattttacttttacttaaagcatttggtnatttggantatctggttctannctaaaaaaantaattctatnaattgaanttttggtactcnnccatatttggatcc

SEQ ID NO: 101 - DNA, 592 bp, Homo sapiens
  misc_feature 218, 497, 502, 533, 544, 546, 548, 550, 555: n = A,T,C or G
gtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcaganaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtacataatgcntttanatatacctatcaagtttgttgataaatgacncaatgaagtgncncnanttggnggttgaatttaatgaatgcctaattttattatcccaa

SEQ ID NO: 102 - DNA, 587 bp, Homo sapiens
  misc_feature 91, 131, 256, 263, 332, 392, 400, 403, 461, 496, 497, 499,510, 511, 518, 519, 539, 554, 560, 576: n = A,T,C or G
cgtcctaagcacttagactacatcagggaagaacacagaccacatccctgtcctcatgcggcttatgttttctggaagaaagtggagaccnagtccttggctttagggctccccggctgggggctgtgcantccggtcagggcgggaagggaaatgcaccgctgcatgtgaacttacagcccaggcggatgccccttcccttagcactacctggcctcctgcatcccctcgcctcatgttcctcccaccttcaaanaatgaanaaccccatgggcccagccccttgccctggggaaccaaggcagccttccaaaactcaggggctgaagcanactattagggcaggggctgactttgggtgacactgcccattccctctcagggcagctcangtcacccnggnctcttgaacccagcctgttcctttgaaaaagggcaaaactgaaaagggcttttcctanaaaaagaaaaaccagggaactttgccagggcttcnntnttaccaaaacnncttctcnnggatttttaattccccattnggcctccacttaccnggggcnatgccccaaaattaanaatttcccatc

SEQ ID NO: 103 - DNA, 496 bp, Homo sapiens
  misc_feature 2, 17, 66, 74, 82, 119, 164, 166, 172, 200, 203, 228, 232,271, 273, 415, 423, 445, 446, 473: n = A,T,C or G
anaggactggccctacntgctctctctcgtcctacctatcaatgcccaacatggcagaacctgcancccttggncactgcanatggaaacctctcagtgtcttgacatcaccctacccntgcggtgggtctccaccacaaccactttgactctgtggtccctgnanggtggnttctcctgactggcaggatggaccttanccnacatatccctctgttccctctgctnaganaaagaattcccttaacatgatataatccacccatgcaantngctactggcccagctaccatttaccatttgcctacagaatttcattcagtctacactttggcattctctctggcgatagagtgtggctgggctgaccgcaaaaggtgccttacacactggcccccaccctcaaccgttgacncatcagangcttgcctcctccttctgattnncccccatgttggatatcagggtgctcnagggattggaaaagaaacaaaac

SEQ ID NO: 104 - DNA, 575 bp, Homo sapiens
  misc_feature 18, 19, 45, 68, 77, 132, 155, 174, 219, 226, 238, 259, 263,271, 273, 306, 323, 339, 363, 368, 370, 378, 381, 382, 436,440, 449, 450, 456, 481, 485, 496, 503, 510, 512, 515, 528,542, 552: n = A,T,C or G
gcacctgctctcaatccnnctctcaccatgatcctccgcctgcanaaactcctctgccaactatggangtggtttcnggggtggctcttgccaactgggaagaagccgtggtgtctctacctgttcaactcngtttgtgtctgggggatcaactnggggctatggaagcggctnaactgttgttttggtggaagggctggtaattggctttgggaagtngcttatngaagttggcctngggaagttgctattgaaagtngccntggaagtngntttggtggggggttttgctggtggcctttgttnaatttgggtgctttgtnaatggcggccccctcncctgggcaatgaaaaaaatcaccnatgcngnaaacctcnacnnaacagcctgggcttccctcacctcgaaaaaagttgctccccccccaaaaaaggncaancccctcaanntggaangttgaaaaaatcctcgaatggggancccnaaaacaaaaanccccccntttcccngnaangggggaaataccncccccccacttacnaaaacccttntaaaaaaccccccgggaaaaaaa

SEQ ID NO: 105 - DNA, 619 bp, Homo sapiens
  misc_feature 260, 527, 560, 564, 566, 585, 599: n = A,T,C or G
cactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcanaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagacttccaaaaaatgaagtccctggtttttcatggcaacttgatcagtaaaggattcncctctgtttggtacttaaaacatctactatatngttnanatgaaattccttttccccncctcccgaaaaaanaaagtggtggggaaaaaaaa

SEQ ID NO: 106 - DNA, 506 bp, Homo sapiens
  misc_feature 8, 21, 31, 32, 58, 75, 89, 96, 99, 103, 122, 126, 147, 150,158, 195, 210, 212, 219, 226, 246, 248, 249, 255, 258, 261,263, 265, 275, 304, 317, 321, 331, 337, 340, 358, 371, 377,380, 396, 450, 491: n = A,T,C or G
cattggtnctttcatttgctntggaagtgtnnatctctaacagtggacaaagttcccngtgccttaaactctgtnacacttttgggaantgaaaanttngtantatgataggttattctgangtanagatgttctggataccattanatntgcccccngtgtcagaggctcatattgtgttatgtaaatggtatntcattcgctactatnantcaattngaaatanggtctttgggttatgaatantnngcagcncanctnanangctgtctgtngtattcattgtggtcatagcacctcacancattgtaacctcnatcnagtgagacanactagnaanttcctagtgatggctcangattccaaatggnctcatntcnaatgtttaaaagttanttaagtgtaagaaatacagactggatgttccaccaactagtacctgtaatgacnggcctgtcccaacacatctcccttttccatgactgtggtancccgcatcggaaaaa

SEQ ID NO: 107 - DNA, 452 bp, Homo sapiens
  misc_feature 289, 317, 378: n = A,T,C or G
gttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagantttcagtttgttggaaagtaactgtganaacccagtttcccgtccatctcccttagggactacccatagaacatgaaaaggtccccacngaagcaagaagataagtctttcatggctgctggttgcttaaaccactttaaaaccaaaaaattccccttggaaa

SEQ ID NO: 108 - DNA, 502 bp, Homo sapiens
  misc_feature 22, 31, 126, 168, 183, 205, 219, 231, 236, 259, 283, 295,296, 298, 301, 340, 354, 378, 383, 409, 433, 446, 455, 466,488: n = A,T,C or G
atcttcttcccttaattagttnttatttatntattaaattttattgcatgtcctggcaaacaaaaagagattgtagattggcttctggctccccaaaagcccataacagaaagtaccacaagaccncaactgaagcttaaaaaatctatcacatgtataatacctttngaagaacattaatanagcatataaaacttttaacatntgcttaatgttgtncaattataaaantaatngaaaaaaatgtccctttaacatncaatatcccacatagtgttatttnaggggattaccnngnaanaaaaaaagggtagaagggatttaatgaaaactctgcttnccatttctgtttanaaacgtctccagaacaaaaacttntcaantctttcagctaaccgcatttgagctnaggccactcaaaaactccattagncccactttctaanggtctctanagcttactaanccttttgaccccttaccctggntactcctgccctca

SEQ ID NO: 109 - DNA, 1308 bp, Homo sapiens
acccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacagttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccactggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatggtggctcacttgcattt

SEQ ID NO: 110 - protein, 391 aa, Homo sapiens [sequence omitted]

SEQ ID NO: 111 - DNA, 1419 bp, Homo sapiens
ggagaactataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtggtaagaataaaggctgaaggaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacagttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccactggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatggtggctcacttgcattt

SEQ ID NO: 112 - protein, 400 aa, Homo sapiens [sequence omitted]

SEQ ID NO: 113 - DNA, 957 bp, Homo sapiens
ctcgaccttctctgcacagcggatgaaccctgagcagctgaagaccagaaaagccactatgactttctgcttaattcaggagcttacaggattcttcaaagagtgtgtccagcatcctttgaaacatgagttcttaccagcagaagcagacctttaccccaccacctcagcttcaacagcagcaggtgaaacaacccagccagcctccacctcaggaaatatttgttcccacaaccaaggagccatgccactcaaaggttccacaacctggaaacacaaagattccagagccaggctgtaccaaggtccctgagccaggctgtaccaaggtccctgagccaggttgtaccaaggtccctgagccaggatgtaccaaggtccctgagccaggttgtaccaaggtccctgagccaggctacaccaaggtccctgagccaggcagcatcaaggtccctgaccaaggcttcatcaagtttcctgagccaggtgccatcaaagttcctgagcaaggatacaccaaagttcctgtgccaggctacacaaaggtaccagagccatgtccttcaacggtcactccaggcccagctcagcagaagaccaagcagaagtaatttggtgcacagacaagcccttgagaagccaaccaccagatgctggacaccctcttcccatctgtttctgtgtcttaattgtctgtagaccttgtaatcagtacattctcaccccaagccatagtctctctcttatttgtatcctaaaaatacggtactataaagcttttgttcacacacactctgaagaatcctgtaagcccctgaattaagcagaaagtcttcatggcttttctggtcttcggctgctcagggttcatctgaagattcgaatgaaaagaaatgcatgtttcctgctctgccctcattaaattgcttttaattccaaaaaaaaaaaaaaaaaaaa

SEQ ID NO: 114 - protein, 161 aa, Homo sapiens
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGYTKVPEPGSIKVPDQGFIKFPEPGAIKVPEQGYTKVPVPGYTKVPEPCPSTVTPGPAQQKTKQK

SEQ ID NO: 115 - DNA, 506 bp, Homo sapiens; identical to SEQ ID NO: 106
  misc_feature 8, 21, 31, 32, 58, 75, 89, 96, 99, 103, 122, 126, 147, 150,158, 195, 210, 212, 219, 226, 246, 248, 249, 255, 258, 261,263, 265, 275, 304, 317, 321, 331, 337, 340, 358, 371, 377,380, 396, 450, 491: n = A,T,C or G

SEQ ID NO: 116 - DNA, 3079 bp, Homo sapiens
ggatccccgggtttcctaaaccccccacagagtcctgcccaggccaaagagcaaggaaaaggtcaaagggcagaaaaaatgctgagttaggaggagctatggaaggataaacctggccttaaagaggtcaaagtggtttatagggggcgctgagggcttcccacattctctggcctaaaccttgcaggcagatctgcccagtgggctctgggatagctgtgccttccctaacaaaaaaattgtgcacaaaaggatgaaactctattttccctctagcacataaccaagaatataaggctacagattgcctttcccagagggaaaaccctgcagcaacctgctgcctggaaaagtgtaagagcagatcactggggaatcgtttgccccccgctgatggacagcttccccaagctccaagggcaggtgctcagcatgtaccgtactgggatggttgtcaatactcctggtcctgtaagagtcccaggacactgccatgccaatgccccctcagttcctggcatcctttttgggctgctcacagccccagcctctatggtgaagacatacttgctagcagcgtcaccaacttgttgccaagagatcagtgctcgaaggcaaggttatttctaactgagcagagcctgccaggaagaaagcgtttgcaccccacaccactgtgcaggtgtgaccggtgagctcacagctgccccccaggcatgcccagcccacttaatcatcacagctcgacagctctctcgcccagcccagttctggaagggataaaaaggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtcttccggagcggggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtagccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgttttataatataagctggtgtgcagaattgttttttttttctacccaa

SEQ ID NO: 117 - DNA, 6921 bp, Homo sapiens
gaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttcgatatagtgaccttctttgcatattaaaatgtttaccacaatgtcccatttctagttaagtcttcgcacttgaaagctaacattatgaatattatgtgttggaggaggggaaggattttcttcattctgtgtattttccgg

SEQ ID NO: 118 - DNA, 946 bp, Homo sapiens
cttctgactgggctcaggctgacaggtagagctcaccatggcttcttgtgtccttgtcccctccccatcacagctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctgtcctctcctggcctccagtctcccctgctgtcccaggtagagctggggatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactgtttgcaattgctaaataaagcagatttataatacatatattcttttactttgccttgctttggggccaaagttttgggcttaaacttttttatctgataagtgaatagttgtttttaaaagataatcta

SEQ ID NO: 119 - DNA, 8948 bp, Homo sapiens
tcaacagcccctgctccttgggcccctccatgccatgccgtaatctctcccacccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatcgtaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccagcgtgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactag

SEQ ID NO: 120 - DNA, 587 bp, Homo sapiens; identical to SEQ ID NO: 102
  misc_feature 91, 131, 256, 263, 332, 392, 400, 403, 461, 496, 497, 499,510, 511, 518, 519, 539, 554, 560, 576: n = A,T,C or G

SEQ ID NO: 121 - DNA, 619 bp, Homo sapiens; identical to SEQ ID NO: 105
  misc_feature 260, 527, 560, 564, 566, 585, 599: n = A,T,C or G

SEQ ID NO: 122 - DNA, 1475 bp, Homo sapiens
tccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaagatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagat

SEQ ID NO: 123 - DNA, 2294 bp, Homo sapiens
cagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctaatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgctattttgcagtagagtcatctccatcagctgtaagaagagctgggaatataggctctgcacagatggatttgcctgtgccaccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggctcgaagggagagccagctcccccgaccggtgggcatttgtgaggcccatggttgagaaatgaataatttcccaattaggaagtgtaagcagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatg

SEQ ID NO: 124 - DNA, 956 bp, Homo sapiens
gatgagttccgcaccaagtttgagacagaccaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggacgcagccgccccatctgccccacagtctccggcctctccagcctcagccccctgcttcagtcccttccccatgcttccttgcctgatgacaataaaagcttgttgactcagctatg

SEQ ID NO: 125 - DNA, 486 bp, Homo sapiens
  misc_feature 16: n = A,T,C or G
aaattatatatagtgnttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttact

SEQ ID NO: 126 - DNA, 3552 bp, Homo sapiens
cggcaggcaggtctcgtctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgctggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacagatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaat

SEQ ID NO: 127 - DNA, 754 bp, Homo sapiens
ttttttttttttgtcattgttcattgattttaatgagaaagctaagagaggaaataagtagcctttcaaaggtcacacagaagtaagtgacagatccaggattcatatccaagcattctggctctagtgtccatgcttctcaaccattatgacccaatattcaaccaaatcaatactgaaggacacgtgaaatgtatccggtattttactattacaaacaaaaatccaatgaacattcttgaagacatacacaaaaataatggttacaatagaagttactggaattgaaattttggttcaacctatattaaaatgtaaggcttttgatatagctaatagatttttgaaatgatcagtcttaacgtttgtaggggagcacactcctgcatggggaaaagattcactgtgaagcacagagcacctttatggttggatcatcttgtcattaaagttcaggcgttatctatcctgtaagtggcagaatcaagactgcaatatcgcctgcttttctttttaactcatgttttcccttgactacactggtcctcaaagtaaaacccctgtgtcagtgtactattcatggaatactctgcaattataaccaccttctaatacttttaatacccaatcaaaatttattatacatatgtatcatagatactcatctgtaaagctgtgcttcaaaatagtgatctcttcccaacattacaatatatattaatgatgtcgaacctgcccgggcggccgctcgaag

SEQ ID NO: 128 - DNA, 374 bp, Homo sapiens
aggttttgattaaaaaggcaaatgattttattgttcgataatcttttaaaaaaataagaggaaggagtaaaattaaagatgaaagatgatttttatttccttgtgacctctatatcccccttcccctgcccttggtaagtaactcttgatggagaaaggattaaagactcttatttaaccaaaaaacagagccagctaatcatttccaaaggttagtatctccctgctgacctcttctttggtttaattgaataaaactatatgttcatatatgtattaaaacaactcagaataacatcttttcttccttagttaaggcattataagggctatactatcatccataataaccaaggcaataacttaaaaagctg

SEQ ID NO: 129 - DNA, 546 bp, Homo sapiens
agtgtgatggatatctgcagaattcgggctaagcgtggtcgcggcccgaggtctggaacttcccagcacytgaaaaggagcctcctgagctgactcggctaaagccccactttcgctcctcctcatttctgcctactgatttccttggagcattcatctgaatattaccgtttgctgtgtaacctggtacatacatagcatgactccctggaatagagtgggctggggtgcttatgctgggagagtgattgacatgcactttcaagctatatctaccatttgcagcaaaggagaaaaaatacctcgagtaaattccatcattttttataacatcagcacctgctccatcatcaaggagtctcagcgtaacaggatctccagtctctggctcaactgtggcagtgacagtggcattaagaatgggataaaatccctgtttcacattggcataaatcatcacaggatgaggaaaatggaggctgtctctttccacaaaggcttccacagtggctgggggcacagacctgcccgggcggccgctcgaaa

SEQ ID NO: 130 - DNA, 5156 bp, Homo sapiens
accaaccgaggcgccgggcagcgacccctgcagcggagacagagactgagcggcccggcaccgccatgcctgcgctctggctgggctgctgcctctgcttgtcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactccggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgtcactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatggtcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttagaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagaaaaaaaaaa

SEQ ID NO: 131 - DNA, 671 bp, Homo sapiens
aggtctggagggcccacagccggatgtgggacaccgggaaaaagtggtcatagcacacatttttgcatcccggttgcagtgtgttgcagacgaagtcctcttgctcgtcaccccacacttcctgggcagccaycacgaggatcatgactcggaaaataaagatgactgtgatccacaccttcccgatgctggtggagtgtttgttgacacccccgatgaaagtgtgcagcgtcccccaatccattgcgctggtttatccctgagtcctgtttccaacgactgccagtgtttcagacccaaagaatgagggcaagatccctctgcgagggtttcagacctccttctcctaccccactggagtgcctagaagccaatgggtgcacagtgatgatacgaatgtcaatctttgctcggtcagtgaggatgtcgcctggaatattcaaattgaattacagatgcatgaagagggcgtacaagttagaatttttctttcgccatacagaaattgtttagccagatcttctgtacttcttttccttccctgacccttcctgctccccaggaagggaggtcagccccgtttgcaaaacacaggatgcccgtgacaccggagacaggtcttcttcaccgacaggaagtgccttctggtgcctgcacgttttaactgctat

SEQ ID NO: 132 - DNA, 590 bp, Homo sapiens
ctgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagacct

SEQ ID NO: 133 - DNA, 581 bp, Homo sapiens
aggtcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagacctc

SEQ ID NO: 134 - DNA, 4797 bp, Homo sapiens
  misc_feature 135, 501, 4421, 4467, 4468, 4698: n = A,T,C or G
cctgggaccaaagtgctgcccagagctgagggtcctggagccacatgagaaggcttctccctgtgtacctgtgcagcacagggtagggtgagtccactcagctgtctaggagaggacccaggagcagcagagacncgccaagcctttactcataccatattctgatccttttccagcaaattgtggctactaatttgccccctgaagatcaagatggctctggggatgactctgacaacttctccggctcaggtgcaggtgaggttgtcatgggggccccccccacccaagacggcaacaggtcatgcctgggggcagtggtcaggcagtctcctgtgtttactgagcatgtactgagtgcaccctgcctgccctgtctccacccagctggctccaaagggcaatgctgaggagaggaatggggtcgtgagctgctgttaaggagagctcatgcttggaggtgaggtgaaggctgtgagctccagaaggccccagggcgcnctgctgcacgcaggctcatattcactaggaatagctttactcactaagaaacctctggaacccccttcagaaggttatttgactcctgagcctctattttctcatctgcaaaatgggaataataccttgacctgataagcttgtggagctgtaaggcagcacagagccagctggggtgtagctcttccatccaagctcccttccttacttcccctttcctgtggggactgggggagagaagtccctgagctggaggtggtcagggaagcttcacagaggaggtggctcttgagtggacctcaggaagaggggtgagagagctaaggaaggaggctgaggtcatccctggggaagtgacctagcggaggcctgagagctgcaaggtaggatatctgttgttggaagtgtctgttgttggaagtgggggcctttttttcagggagggtggggccagagaagtgtgtgccctgggataagtaggataaccacagtagttatgcccctaagggatgcccaccccacccctgtggtcacagaaaagctttcccaggtggcctaggcacctgtctcgtggctccagagacaggctgcacctgacacacacaatggaaggacagctctccttgtccattttccaaggagcttagcctcagctgccttgtccaggtactagcctccctcatagcctgagcttggccagcccaggtgctctggagcctcccccgacccacccaacacactctgcttctggtcctccccaccccccacctccccaacacactctgcttctggtcctgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggtgagtggcctctgcattccttgggaaattgagtgggttggtcctaatgcctggcacttggcaggccctacacctgtgccctgcgcgatctcgtattcctcaccaggaagacagggcacaggggccgccttcccctacccccagggcctcgcagagcaggacagactaactatgagatcagagcagaagcacccttaaagatcacccaagagagggctcccaaactcacaatccaaacttgcagccctcgtcgaagagtgaacgttataccagtcattttatttatagcttcgtggatttacgcttacactaaatagtctgctattcatacaaaatgtgtgctttgtatcactttttgtgatatccatgccatggtccagccagggtccggagttgatgtggcaagaaggcctggctttcgggccctgtgcgatcctggtttgggtgcatctgagtgggtggtggcaaagatcagggaggcaggagctgcttctgggtctgtagtggagctggttgctgctgctggcggtgacctggccaacccaatctgcccctgccctcccacaggacttcacctttgaaacctcgggggagaatacggctgtagtggccgtggagcctgaccgccggaaccagtccccagtggatcagggggccacgggggcctcacagggcctcctggacaggaaagaggtgctgggaggtgagttttctttcaggggggtagtttggggtgaattgctgctgtggggtcagggtggggctgaccacagccaaggccactgctttgggagggtctgcacgagagcccaaggagccgctgagctgagctggccccgtctacctgccctaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtgggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtcactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagacttttttttttttttttaaactaggagaaccaaatctggaagccaaaatgtaggcttagtttgtgtgttgtctcttgagtttgtcgctcatgtgtgcaacagggtatggactatctgtctggtggccccgttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcaggctcacgcccgtcctcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagcccatcttctaaatggcaaaggaaggtggatggccccagcacagcttgacctgaggctgtggtcacagcggaggtgtggagccgaggcctaccccncagacaccttggacatcctcctcccacccggctgcagaggccagannccagcccagggtcctgcacttacttgcttatttgacaacgtttcagcgactccgttggccactccgagagtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtncccaagccagaggtgggttcatttgtgtaacgacaataaacggtacttgtcatttcgggcaacggctgctgtggtggtggttgagtctcttcttggcct

SEQ ID NO: 135 - DNA, 2856 bp, Homo sapiens
tagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggctgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcctttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgataagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatcgcattattttgaatgtgaagggaa

SEQ ID NO: 136 - DNA, 356 bp, Homo sapiens
ggtggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggactcagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacgg

SEQ ID NO: 137 - DNA, 356 bp, Homo sapiens
  misc_feature 254, 264, 279, 281, 290, 328, 342: n = A,T,C or G
gcaggtggagaagacattttattgttcctggggtctctggaggcccattggtggggctgggtcactggctgcccccggaacagggcgctgctccatggctctgcttgtggtagtctgtggctatgtctcccagcaaggacagaaactcagaaaaatcaatcttcttatcctcattcttgtcctttttctcaaagacatcggcgaggtaatttgtgccctttttacctcggcccgcgaccacgctaaggccaaanttccagacanayggccgggccggtncnataggggancccaacttggggacccaaactctggcgcggaaacacangggcataagcttgnttcctgtggggaaa

SEQ ID NO: 138 - DNA, 353 bp, Homo sapiens
aggtccagtcctccacttggcctgatgagagtggggagtggcaagggacgtttctcctgcaatagacacttagatttctctcttgtgggaagaaaccacctgtccatccactgactcttctacattgatgtggaaattgctgctgctaccaccacctcctgaagaggcttccctgatgccaatgccagccatcttggcatcctggccctcgagcaggctgcggtaagtagcgatctcctgctccagccgtgtctttatgtcaagcagcatcttgtactcctggttctgagcctccatctcgcatcggagctcactcagacctcgsccgsgmssmcgctamgccgaattccagc

SEQ ID NO: 139 - DNA, 371 bp, Homo sapiens
agcgtggtcgcggccgaggtccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggacctgcccgggcggccgctcgaaagccgaattccagcacactggcggccgttactagtggatc

SEQ ID NO: 140 - DNA, 370 bp, Homo sapiens
tagcgtggtcgcggccgaggtccatctccctttgggaactagggggctgctggtgggaaatgggagccagggcagatgttgcattcctttgtgtccctgtaaatgtgggactacaagaagaggagctgcctgagtggtactttctcttcctggtaatcctctggcccagcctcatggcagaatagaggtatttttaggctatttttgtaatatggcttctggtcaaaatccctgtgtagctgaattcccaagccctgcattgtacagccccccactcccctcaccacctaataaaggaatagttaacactcaaaaaaaaaaaaaaacctgcccgggcggccgctcgaaagccgaattccagcacactggc

SEQ ID NO: 141 - DNA, 371 bp, Homo sapiens
tagcgtggtcgcggccgaggtcctctgtgctgcctgtcacagcccgatggtaccagcgcagggtgtaggcagtgcaggagccctcatccagtggcagggaacaggggtcatcactatcccaaggagcttcagggtcctggtactcctccacagaatactcggagtattcagagtactcatcatcctcagggggtacccgctcttcctcctctgcatgagagacgcggagcacaggcacagcatggagctgggagccggcagtgtctgcagcataactagggaggggtcgtgatccagatgcgatgaactggccctggcaggcacagtgctgactcatctcttggcgacctgcccgggcggccgctcgaagc

SEQ ID NO: 142 - DNA, 343 bp, Homo sapiens
gcgttttgaggccaatggtgtaaaaggaaatatcttcacataaaaactagatggaagcattgtcagaaacctctttgtgatgtttgctttcaactcacagagttgaacattccttttcatagagcagttttgaaacactcttttgtagaatttgcaagcggatgattggatcgctatgaggtcttcattggaaacgggatacctttacataaaaactagacagtagcattctcagaaatttctttgggatgtgggcattcaacccacagaggagaacttcatttgatagagcagttttgaaacaccctttttgtagaatctacaggtggacatttagagtgct

SEQ ID NO: 143 - DNA, 354 bp, Homo sapiens
aggtctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcat

SEQ ID NO: 144 - DNA, 353 bp, Homo sapiens
ggtcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtgg

SEQ ID NO: 145 - DNA, 371 bp, Homo sapiens
caggtctgtcataaactggtctggagtttctgacgactccttgttcaccaaatgcaccatttcctgagacttgctggcctctccgttgagtccacttggctttctgtcctccacagctccattgccactgttgatcactagctttttcttctgcccacaccttcttcgactgttgactgcaatgcaaactgcaagaatcaaagccaaggccaagagggatgccaagatgatcagccattctggaatttggggtgtccttataggaccagaggttgtgtttgctccaccttcttgactcccatgtgagacctcggccgcgaccacgctaagccgaattccagcacactggcggcccgttactagtggatccg

SEQ ID NO: 146 - DNA, 355 bp, Homo sapiens
ggtcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctc

SEQ ID NO: 147 - DNA, 355 bp, Homo sapiens
ggtctgttacaaaatgaagacagacaacacaacatttactctgtggagatatcctactcatactatgcacgtgctgtgattttgaacataactcgtcccaaaaacttgtcacgatcatcctgactttttaggttggctgatccatcaatcttgcactcaactgttacttctttcccagtgttgttaggagcaaagctgacctgaacagcaaccaatggctgtagatacccaacatgcagttttttcccataatatgggaaatattttaagtctatcattccattatgaggataaactgctacatttggtatatcttcattctttgaaacacaatctatccttggcactccttcag

SEQ ID NO: 148 - DNA, 369 bp, Homo sapiens
aggtctctctccccctctccctctcctgccagccaagtgaagacatgcttacttccccttcaccttccttcatgatgtgggaagagtgctgcaacccagccctagccaacaccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccatccagcctgaggatgacatcaatacacagaggaagaagagtcaggaaaagatgagagaagttacagactctcctgggcgaccccgagagcttaccattcctcagacttcttca

SEQ ID NO: 149 - DNA, 620 bp, Homo sapiens; identical to SEQ ID NO: 94
  misc_feature 169, 171, 222, 472, 528, 559, 599: n = A,T,C or G

SEQ ID NO: 150 - DNA, 371 bp, Homo sapiens
ggtccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgyaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttata

SEQ ID NO: 151 - DNA, 4655 bp, Homo sapiens
gggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctyctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactggtatacttaccagtgaggggccgtgagacttatgaaatgctggtgaagatcaaagagtccctggaactcatgcagtaccttcttcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggcttacttcttaccctaaccatctgacctggcatctaattctgattctggctttaagccttcaaaactatagcttgcagaactgtagcttgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcytttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaatccctgtactgtgtctcatggatttggcactagccaaagcgaggcaccccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaacta

SEQ ID NO: 152 - protein, 586 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPSSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELVYLPVRGRETYEMLVKIKESLELMQYLLQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 153 - DNA, 2007 bp, Homo sapiens
gaattcgtcgctgctccagggaaagttctgttactccactgactctctcttttcctgataacatggccagcaagaaagtaattacagtgtttggagcaacaggagctcaaggtggctctgtggccagggcaattttggagagcaaaaaatttgcagtgagagcagtgaccagggatgtgacttgaccaaatgccctggagctccagcgccttggagctgaggtggtcaaaggtgacctgaatgataaagcatcggtggacagtgccttaaaaggtgtctatggggccttcttggtgaccaacttctgggaccctctcaaccaagataaggaagtgtgtcgggggaagctggtggcagactccgccaagcacctgggtctgaagcacgtggtgtacagcggcctggagaacgtcaagcgactgacggatggcaagctggaggtgccgcactttgacagcaagggcgaggtggaggagtacttctggtccattggcatccccatgaccagtgtccgcgtggcggcctactttgaaaactttctcgcggcgtggcggcccgtgaaagcctctgatggagattactacaccttggctgtaccgatgggagatgtaccaatggatggtatctctgttgctgatattggagcagccgtctctagcatttttaattctccagaggaatttttaggcaaggccgtggggctcagtgcagaagcactaacaatacagcaatatgctgatgttttgtccaaggctttggggaaagaagtccgagatgcaaagattaccccggaagctttcgagaagctgggattccctgcagcaaaggaaatagccaatatgtgtcgtttctatgaaatgaagccagaccgagatgtcaatctcacccaccaactaaatcccaaagtcaaaagcttcagccagtttatctcagagaaccagggagccttcaagggcatgtagaaaatcagctgttcagataggcctctgcaccacacagcctctttcctctctgatccttttcctctttacggcacaacattcatgttgacagaacatgctggaatgcaattgtttgcaacaccgaaggatttcctgcggtcgcctcttcagtaggaagcactgcattggtgataggacacggtaatttgattcacatttaacttgctagttagtgataagggtggtacaactgtttggtaaaatgagaagcctcggaacttggagcttctctcctaccactaatgggagggcagattatactgggatttctcctgggtgagtaatttcaagccctaatgctgaaattcccctaggcagctccagttttctcaactgcattgcaaaattcccagtgaacttttaagtacttttaacttaaaaaaatgaacatctttgtagagaattttctggggaacatggtgttcaatgaacaagcacaagcattggaaatgctaaaattcagttttgcctcaagattggaagtttattttctgactcattcatgaagtcatctattgagccaccattcaattattcatctattaattccttgatccttcatttatccattctgcaaacttttcttgagcaccagcacgggtggccatttgtggacttctcttcattcctatgtgttttcttatcaaagtgatccactctcgaaaggctcctttccagtctgtggttgggttcaagtcatgccagggccagggggcccatctcctcgtttagctctaggcaaaatccaggggatctgcagtggggagcgggggcaggaagctggagggaaggcctgtgaagggtagggatgtggaaagacaaggtgacagaaggacccaataggacctttctatatctctggcttagcattttctacatcatattgtaatcgtcttatttgctagttttcttccttactgtgagtgactaacagtcatctttatcccagtgcctggtacataataagtgatcaataaatgttgattgactaaaaaaaaaaaaaaaa

SEQ ID NO: 154 - DNA, 2148 bp, Homo sapiens
gaattcgtcgctgctccagggaaagttctgttactccactgactctctcttttcctgataacatggccagcaagaaagtaattacagtgtttggagcaacaggagctcaaggtggctctgtggccagggcaattttggagagcaaaaaatttgcagtgagagcagtgaccagggatgtgacttgaccaaatgccctggagctccagcgccttggagctgaggtggtcaaaggtgacctgaatgataaagcatcggtggacagtgccttaaaaggggaagctggtggcagactccgccaagcacctgggtctgaagcacgtggtgtacagcggcctggagaacgtcaagcgactgacggatggcaagctggaggtgccgcactttgacagcaagggcgaggtggaggagtacttctggtccattggcatccccatgaccagtgtccgcgtggcggcctactttgaaaactttctcgcggcgtggcggcccgtgaaagcctctgatggagattactacaccttggctgtaccgatgggagatgtaccaatggatggtatctctgttgctgatattggagcagccgtctctagcatttttaattctccagaggaatttttaggcaaggccgtggggctcagtgcagaagcactaacaatacagcaatatgctgatgttttgtccaaggctttggggaaagaagtccgagatgcaaagactatctgtgctatagatgaccagaaaacagtggaagaaggtttcatggaagacgtgggcttgagttggtccttgagggaacatgaccatgtatagacagaggaggcatcaagaaggctggcctggctaattctggaataaacacgacaaaccagaggcagtacgggaaggaggcaaattctggctctgcctctatccttgattaccccggaagctttcgagaagctgggattccctgcagcaaaggaaatagccaatatgtgtcgtttctatgaaatgaagccagaccgagatgtcaatctcacccaccaactaaatcccaaagtcaaaagcttcagccattttatctcagagaaccagggagccttcaagggcatgtagaaaatcagctgttcagataggcctctgcaccacacagcctctttcctctctgatccttttcctctttacggcacaacattcatgttgacagaacatgctggaatgcaattgtttgcaacaccgaaggatttcctgcggtcgcctcttcagtaggaagcactgcattggtgataggacacggtaatttgattcacatttaacttgctagttagtgataagggtggtacaactgtttggtaaaatgagaagcctcggaacttggagcttctctcctaccactaatgggagggcagattatactgggatttctcctgggtgagtaatttcaagccctaatgctgaaattcccctaggcagctccagttttctcaactgcattgcaaaattcccagtgaacttttaagtacttttaacttaaaaaaatgaacatctttgtagagaattttctggggaacatggtgttcaatgaacaagcacaagcattggaaatgctaaaattcagttttgcctcaagattggaagtttattttctgactcattcatgaagtcatctattgagccaccattcaattattcatctattaattccttgatccttcatttatccattctgcaaacttttcttgagcaccagcacgggtggccatttgtggacttctcttcattcctatgtgttttcttatcaaagtgatccactctcgaaaggctcctttccagtctgtggttgggttcaagtcatgccagggccagggggcccatctcctcgtttagctctaggcaaaatccaggggatctgcagtggggagcgggggcaggaagctggagggaaggcctgtgaagggtagggatgtggaaagacaaggtgacagaaggacccaataggacctttctatatctctggcttagcattttctacatcatattgtaatcgtcttatttgctagttttcttccttactgtgagtgactaacagtcatctttatcccagtgcctggtacataataagtgatcaataaatgttgattgactaaatgaaaaaaaaaaaaaaaaaaa

SEQ ID NO: 155 - protein, 153 aa, Homo sapiens
MTSVRVAAYFENFLAAWRPVKASDGDYYTLAVPMGDVPMDGISVADIGAAVSSIFNSPEEFLGKAVGLSAEALTIQQYADVLSKALGKEVRDAKITPEAFEKLGFPAAKEIANMCRFYEMKPDRDVNLTHQLNPKVKSFSQFISENQGAFKGM

SEQ ID NO: 156 - protein, 128 aa, Homo sapiens
MTSVRVAAYFENFLAAWRPVKASDGDYYTLAVPMGDVPMDGISVADIGAAVSSIFNSPEEFLGKAVGLSAEALTIQQYADVLSKALGKEVRDAKTICAIDDQKTVEEGFMEDVGLSWSLREHDHVAGA

SEQ ID NO: 157 - DNA, 424 bp, Homo sapiens
  misc_feature 320, 322: n = A,T,C or G
ctgcagcccgggggatccactagtccagtgtggtggaattcattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcngnatctggcttgtccatctggtctaaggtggctgcttcttccccagccatcgagtcagtttgtgcccatgaataatacacgacctgctatttcccatgactgct

SEQ ID NO: 158 - DNA, 2099 bp, Homo sapiens
ccgcggttaaaaggcgcagcaggtgggagccggggccttcacccgaaacccgacgagagcccgacagccggcggcgcccgagcccgacctgcctgcccagccggagcgaagggcgccgccccgcgcagagcccgcgccagggccgccggccgcagagcagttaaaacgtgcaggcaccagaaggcacttcctgtcggtgaagaagacctgtctccggtgtcacgggcatcctgtgttttgcaaacggggctgacctcccttcctggggagcaggaagggtcagggaaggaaaagaagtacagaagatctggctaaacaatttctgtatggcgaaagaaaaattctaacttgtacgccctcttcatgcatctttaattcaatttgaatattccaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttctgactttgaatttatataaagtatttttataatgactggtcttccttacctggaaaaacatgcgatgttagttttagaattacaccacaagtatctaaatttggaacttacaaagggtctatcttgtaaatattgttttgcattgtctgttggcaaatttgtgaactgtcatgatacgcttaaggtggaaagtgttcattgcacaatatatttttactgctttctgaatgtagacggaacagtgtggaagcagaaggcttttttaactcatccgtttgccaatcattgcaaacaactgaaatgtggatgtgattgcctcaataaagctcgtccccattgcttaaaaaaaaaaa

SEQ ID NO: 159 - protein, 291 aa, Homo sapiens
MDWGTLHTFIGGVNKHSTSIGKVWITVIFIFRVMILVVAAQEVWGDEQEDFVCNTLQPGCKNVCYDHFFPVSHIRLWALQLIFVSTPALLVAMHVAYYRHETTRKFRRGEKRNDFKDIEDIKKQKVRIEGSLWWTYTSSIFFRIIFEAAFMYVFYFLYNGYHLPWVLKCGIDPCPNLVDCFISRPTEKTVFTIFMISASVICMLLNVAELCYLLLKVCFRRSKRAQTQKNHPNHALKESKQNEMNELISDSGQNAITGSQAKHFKVKCSCVIRRLLSSPEGNTNLKVPSVA

SEQ ID NO: 160 - DNA, 3951 bp, Homo sapiens
tctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaacgggactgagcttccacctcctcccacattctcgcttgtagaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtattaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatatttcatatatgaagcccctaatgcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttttaagttattgccttggttattatggatgatagttatagcccttataatgccttaactaaggaagaaaagatgttattctgagtttgttttaatacatatatgaacatatagttttattcaattaaaccaaagaagaggtcagcagggagatactaacctttggaaatgattagctggctctgttttttggttaaataagagtctttaatcctttctccatcaagagttacttaccaagggcaggggaagggggatatagaggtcccaaggaaataaaaatcatctttcatctttaattttactccttcctcttatttttttaaaagattatcgaacaataaaatcatttgcctttttaattaaaaacataaaaaaa

SEQ ID NO: 161 - protein, 943 aa, Homo sapiens [sequence omitted]

SEQ ID NO: 162 - DNA, 498 bp, Homo sapiens
tggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtggcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacaccccagcggat

SEQ ID NO: 163 - DNA, 1128 bp, Homo sapiens
gccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatg

SEQ ID NO: 164 - DNA, 1310 bp, Homo sapiens
gggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatatttttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcccgtaaaaataacagtattttaaatttgtaaagaatgtctaataaaatataatctaattac

SEQ ID NO: 165 - protein, 177 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 166 - protein, 177 aa, Homo sapiens; identical to SEQ ID NO: 165

SEQ ID NO: 167 - DNA, 3362 bp, Homo sapiens
cacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaacgggactgagcttccacctcctcccacattctcgcttgtagaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtattaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatatttcatatatgaagcccctaatgcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatatatgaacatatagttttattcaattaaaccaaagaagaggtcagcagggagatactaacctttggaaatgattagctggctctgttttttggttaaataagagtctttaatcctttctccatcaagagttacttaccaagggcaggggaagggggatatagaggtcacaaggaaataaaaatcatctttcatctttaattttactccttcctcttatttttttaaaagattatcgaacaataaaatcatttgcctttttt

SEQ ID NO: 168 - DNA, 2784 bp, Homo sapiens
tctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaacgggactgagcttccacctcctcccacattctcgcttgtagaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaatagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattga

SEQ ID NO: 169 - protein, 592 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVEAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLMCFHHAKLLTWKL

SEQ ID NO: 170 - protein, 791 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVEAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVNRRGIDPILDSTWRRL

SEQ ID NO: 171 - DNA, 1491 bp, Homo sapiens
cctcctgccagccaagtgaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctaaaaaaaaaaaaaaa

SEQ ID NO: 172 - protein, 364 aa, Homo sapiens
MWQPLFFKWLLSCCPGSSQIAAAASTQPEDDINTQRKKSQEKMREVTDSPGRPRELTIPQTSSHGANRFVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 173 - DNA, 1988 bp, Homo sapiens
cgggagccgcctccccgcggcctcttcgcttttgtggcggcgcccgcgctcgcaggccactctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccctgctgtcacttacatctataactgggcctacggctttgggtgggcagccacgattatcctgatcggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggacttggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcytgtcacaaaagtgccactaaaacagcctcaggagaataaatgacttgcttttctaaatctcaggtttatctgggctctatcatatagacaggcttctgatagtttgcarctgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaaaaaaaaa

SEQ ID NO: 174 - protein, 238 aa, Homo sapiens
GAASPRPLRFCGGARARRPLSAVARPARSSDPLRSAPLGPAPPVNMIRCGLACERCRWILPLLLLSAIAFDIIALAGRGWLQSSDHGQTSSLWWKCSQEGGGSGSYEEGCQSLMEYAWGRAAAAMLFCGFIILVICFILSFFALCGPQMLVFLRVIGGLLALAAVFQIISLVIYPVKYTQTFTLHANPAVTYIYNWAYGFGWAATIILIGCAFFFCCLPNYEDDLLGNAKPRYFYTSA

SEQ ID NO: 175 - DNA, 4181 bp, Homo sapiens
  misc_feature 3347, 3502, 3506, 3520, 3538, 3549, 3646, 3940, 3968, 3974,4036, 4056, 4062, 4080, 4088, 4115: n = A,T,C or G
ggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatcagtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaaaaaaaattagactccaccttaagtagtaaagtataacaggatttctgtatactgtgcaatcagttctttgaaaaaaaagtcaaaagatagagaatacaagaaaagttttngggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttggnttgnaagatgatcacagncatgttacactgatcttnaaggacatatnttataaccctttaaaaaaaaaatcccctgcctcattcttatttcgagatgaatttcgatacagactagatgtctttctgaagatcaattagacattntgaaaatgatttaaagtgttttccttaatgttctctgaaaacaagtttcttttgtagttttaaccaaaaaagtgccctttttgtcactggtttctcctagcattcatgatttttttttcacacaatgaattaaaattgctaaaatcatggactggctttctggttggatttcaggtaagatgtgtttaaggccagagcttttctcagtatttgatttttttccccaatatttgattttttaaaaatatacacataggagctgcatttaaaacctgctggtttaaattctgtcanatttcacttctagccttttagtatggcnaatcanaatttacttttacttaagcatttgtaatttggagtatctggtactagctaagaaataattcnataattgagttttgtactcnccaaanatgggtcattcctcatgnataatgtncccccaatgcagcttcattttccaganaccttgacgcaggataaattttttcatcatttaggtccccaaaaaaaaaaaaaaaaaaaaaaaaaa

SEQ ID NO: 176 - protein, 579 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHQFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 177 - DNA, 401 bp, Homo sapiens
atgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaatcagttctcaaaaaatgaccggtgcttataaaaagttataaatatcgagtagctctaaaacaaaccacctgaccaagagggaagtgagcttgtgcttagtatttacattggatgccagttttgtaatcactgacttatgtgcaaactggtgcagaaattctataaactctttgctgtttttgatacctgctttttgtttcattttgttttgttttgtaaaaatgataaaacttcagaaaat

SEQ ID NO: 178 - DNA, 561 bp, Homo sapiens
acgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcg

SEQ ID NO: 179 - DNA, 521 bp, Homo sapiens
cccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtatttt

SEQ ID NO: 180 - DNA, 417 bp, Homo sapiens
ggtggaattcgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaa

SEQ ID NO: 181 - DNA, 283 bp, Homo sapiens
  misc_feature 35: n = A,T,C or G
gatttcttctaaataggatgtaaaacttctttcanattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaa

SEQ ID NO: 182 - DNA, 401 bp, Homo sapiens
atattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcata

SEQ ID NO: 183 - DNA, 366 bp, Homo sapiens
  misc_feature 325: n = A,T,C or G
accgtgtccaagtttttagaacccttgttagccagaccgaggtgtcctggtcaccgtttcaccatcatgctttgatgttcccctgtctttctctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattancctgagaaataattaaatatcttttctcttcaaaaaaaaaa

SEQ ID NO: 184 - DNA, 370 bp, Homo sapiens
tcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaa

SEQ ID NO: 185 - DNA, 107 bp, Homo sapiens
ctcatattattttccttttgagaaattggaaactctttctgttgctattatattaataaagttggtgtttattttctggtagtcaccttccccatttaaaaaaaaaa

SEQ ID NO: 186 - DNA, 309 bp, Homo sapiens
gaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccgccccagccagggtgttaatgcccacgtagtggaggcctctggcagatcctgcattccaaggtcactggactgtacgtttttatggtt

SEQ ID NO: 187 - DNA, 477 bp, Homo sapiens
ttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacac

SEQ ID NO: 188 - DNA, 220 bp, Homo sapiens
taaatatggtagatattaatattcctcttagatgaccagtgattccaattgtcccaagttttaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacc

SEQ ID NO: 189 - DNA, 417 bp, Homo sapiens
  misc_feature 76, 77: n = A,T,C or G
accatcttgacagaggatacatgctcccaaaacgtttgttaccacacttaaaaatcactgccatcattaagcatcnntttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 190 - DNA, 497 bp, Homo sapiens
gcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatgg

SEQ ID NO: 191 - DNA, 175 bp, Homo sapiens
atgttgaatattttgcttattaactttgtttattgtcttctccctcgattagaatattagctacttgagtacaaggatttgagcctgttacattcactgctgaattttaggctcctggaagatacccagcattcaatagagaccacacaataaatatatgtcaaataaaaaaaaa

SEQ ID NO: 192 - DNA, 526 bp, Homo sapiens
agtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaaaaa

SEQ ID NO: 193 - DNA, 553 bp, Homo sapiens
  misc_feature 290, 300, 411, 441: n = A,T,C or G
tccattgtggtggaattcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaancgggaagcancattaatactaggtgtaagccctactgccaataaagggaaaataagagatgctcatcgacgaattatgcttttaaatcatcctgacaaaggaggatctccttatatagcanccaaaatcaatgaagctaaagatttactanaaggtcaagctaaaaaatgaagtaaatgtatgatgaattttaagttcgtattagtttatgtatatgagtactaagtttttataataaaatgcctcagagctacaattttaaa

SEQ ID NO: 194 - DNA, 320 bp, Homo sapiens
cccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacct

SEQ ID NO: 195 - DNA, 320 bp, Homo sapiens
  misc_feature 203, 218: n = A,T,C or G
aagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttanaaaggggaggctggnttgtaactttccttgtacttaattgggtaaaagtcttttccacaaaccaccatctattttgtgaactttgttagtcatcttttatttggtaaattatgaact

SEQ ID NO: 196 - DNA, 357 bp, Homo sapiens
  misc_feature 36: n = A,T,C or G
atataaaataatacgaaactttaaaaagcattggantgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaaaaaa

SEQ ID NO: 197 - DNA, 565 bp, Homo sapiens
  misc_feature 27: n = A,T,C or G
tcagctgagtaccatcaggatatttanccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttactgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtaaaaa

SEQ ID NO: 198 - DNA, 484 bp, Homo sapiens
tatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaac

SEQ ID NO: 199 - DNA, 429 bp, Homo sapiens
  misc_feature 77, 88, 134, 151, 189, 227, 274, 319: n = A,T,C or G
gcttatgttttttgttttaacttttgttttttaacatttagaatattacattttgtattatacagtacctttctcanacattttgtanaattcatttcggcagctcactaggattttgctgaacattaaaaagngtgatagcgatattagngccaatcaaatggaaaaaaggtagtcttaataaacaanacacaacgtttttatacaacatactttaaaatattaanaaaactccttaatattgtttcctattaagtattattctttgggcaanattttctgatgcttttgattttctctcaatttagcatttgctttnggtttttttctctatttagcattctgttaaggcacaaaaactatgtactgtatgggaaatgttgtaaatattaccttttccacattttaaacagacaactttgaatccaa

SEQ ID NO: 200 - DNA, 279 bp, Homo sapiens
gcttttttgaggaattacagggaagctcctggaattgtacatggatatctttatccctagggggaaatcaaggagctgggcacccctaattctttatggaagtgtttaaaactattttaattttattacaagtattactagagtagtggttctactctaagatttcaaaagtgcatttaaaatcatacatgttcccgcctgcaaatatattgttattttggtggagaaaaaaatagtatattctacataaaaaattaaagatattaactaagaaaaaaa

SEQ ID NO: 201 - DNA, 569 bp, Homo sapiens
taggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaaagatgaactctcaaaaa

SEQ ID NO: 202 - DNA, 501 bp, Homo sapiens
attaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgc

SEQ ID NO: 203 - DNA, 261 bp, Homo sapiens
  misc_feature 36, 96: n = A,T,C or G
gacaagctcctggtcttgagatgtcttctcgttaangagatgggccttttggaggtaaaggataaaatgaatgagttctgtcatgattcactattntataacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaa

SEQ ID NO: 204 - DNA, 421 bp, Homo sapiens
agcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggcttgtgtgcttggactcggctccaggtggaagcatgctttcccttgttactgttggagaaactcaaaccttcaagccctaggtgtagccattttgtcaagtcatcaactgtatttttgtactggcattaacaaaaaaagaagataaaatattgtaccattaaactttaataaaactttaa

SEQ ID NO: 205 - DNA, 460 bp, Homo sapiens
tactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaaggtgaacttttatttaaaagagagagaatcttatgttttttaaatggagttatgaattttaa

SEQ ID NO: 206 - DNA, 481 bp, Homo sapiens
tgtggtggaattcgggacgcccccagaccctgactttttcctgcgtgggccgtctcctcctgcggaagcagtgacctctgacccctggtgaccttcgctttgagtgccttttgaacgctggtcccgcgggacttggttttctcaagctctgtctgtccaaagacgctccggtcgaggtcccgcctgccctgggtggatacttgaaccccagacgcccctctgtgctgctgtgtccggaggcggccttcccatctgcctgcccacccggagctctttccgccggcgcagggtcccaagcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgt

SEQ ID NO: 207 - DNA, 605 bp, Homo sapiens
accctttttggattcagggctcctcacaattaaaatgagtgtaatgaaacaaggtgaaaatatagaagcatccctttgtatactgttttgctacttacagtgtacttggcattgctttatctcactggattctcacggtaggatttctgagatcttaatctaagctccaaagttgtctacttttttgatcctagggtgctccttttgttttacagagcagggtcacttgatttgctagctggtggcagaattggcaccattacccaggtctgactgaccaccagtcagaggcactttatttgtatcatgaaatgatttgaaatcattgtaaagcagcgaagtctgataatgaatgccagctttccttgtgctttgataacaaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctaccagatatggttttgtggacatctttttctgtttacataa

SEQ ID NO: 208 - DNA, 655 bp, Homo sapiens
ggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttc

SEQ ID NO: 209 - DNA, 621 bp, Homo sapiens
catttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaaccttcccacatgccgtgactctggactatatcagtttttggaaagcagggttcctctgcctgctaacaagcccacgtggaccagtctgaatgtctttcctttacacctatgtttttaaatagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaatt

SEQ ID NO: 210 - DNA, 533 bp, Homo sapiens
  misc_feature 20, 21, 61: n = A,T,C or G
cgccttggggagccggcggnngagtccgggacgtggagacccggggtcccggcagccgggnggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaa

SEQ ID NO: 211 - DNA, 451 bp, Homo sapiens
ttagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcg

SEQ ID NO: 212 - DNA, 471 bp, Homo sapiens
  misc_feature 54: n = A,T,C or G
gtgattattcttgatcagggagaagatcatttagatttgttttgcattccttanaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaac

SEQ ID NO: 213 - DNA, 511 bp, Homo sapiens
  misc_feature 27, 63, 337, 442: n = A,T,C or G
ctaattagaaacttgctgtactttttnttttcttttaggggtcaaggaccctctttatagctnccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggnggttctaaattctgaaactgtagttgagatacagctatttaatatttctgggagatgtgcatccctcttctttgtggttgcccaaggttgttttgcgtaactganactccttgatatgcttcagagaatttaggcaaacactggccatggccgtgggagtactgggagtaaaat

SEQ ID NO: 214 - DNA, 521 bp, Homo sapiens
agcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaa

SEQ ID NO: 215 - DNA, 381 bp, Homo sapiens
  misc_feature 17, 20, 60, 61, 365: n = A,T,C or G
gagcggagagcggaccngtnagagccctgagcagccccaccgccgccgccggcctagttnncatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaangaagatgtatttgtac

SEQ ID NO: 216 - DNA, 425 bp, Homo sapiens
ttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttag

SEQ ID NO: 217 - DNA, 181 bp, Homo sapiens
gagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaa

SEQ ID NO: 218 - DNA, 405 bp, Homo sapiens
caggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagaaaaaaaa

SEQ ID NO: 219 - DNA, 216 bp, Homo sapiens
  misc_feature 207, 210: n = A,T,C or G
actccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctcttnaanaaaaaa

SEQ ID NO: 220 - DNA, 380 bp, Homo sapiens
cttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaaaaaaa

SEQ ID NO: 221 - DNA, 398 bp, Homo sapiens
ggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattaaaaaa

SEQ ID NO: 222 - DNA, 301 bp, Homo sapiens
  misc_feature 49, 64: n = A,T,C or G
ttcgataattgatctcatgggctttccctggaggaaaggttttttttgntgtttattttttaanaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcaaaaaa

SEQ ID NO: 223 - DNA, 200 bp, Homo sapiens
gtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaacttaaaaaaa

SEQ ID NO: 224 - DNA, 385 bp, Homo sapiens
gaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtaaacagagcacttaatgttatttacagtttatattgttttctctggttaccaataaaacgggccattttcaggtggtaaaaaaaa

SEQ ID NO: 225 - protein, 560 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 226 - protein, 9 aa, Homo sapiens
ILIPATWKA

SEQ ID NO: 227 - protein, 9 aa, Homo sapiens
FLLNDNLTA

SEQ ID NO: 228 - protein, 9 aa, Homo sapiens
LLGNCLPTV

SEQ ID NO: 229 - protein, 10 aa, Homo sapiens
KLLGNCLPTV

SEQ ID NO: 230 - protein, 10 aa, Homo sapiens
RLTGGLKFFV

SEQ ID NO: 231 - protein, 9 aa, Homo sapiens
SLQALKVTV

SEQ ID NO: 232 - protein, 20 aa, Homo sapiens
AGADVIKNDGIYSRYFFSFA

SEQ ID NO: 233 - protein, 21 aa, Homo sapiens
FFSFAANGRYSLKVHVNHSPS

SEQ ID NO: 234 - protein, 20 aa, Homo sapiens
FLVTWQASGPPEIILFDPDG

SEQ ID NO: 235 - protein, 20 aa, Homo sapiens
LQSAVSNIAQAPLFIPPNSD

SEQ ID NO: 236 - protein, 20 aa, Homo sapiens
IQDDFNNAILVNTSKRNPQQ

SEQ ID NO: 237 - protein, 21 aa, Homo sapiens
RNSLQSAVSNIAQAPLFIPPN

SEQ ID NO: 238 - protein, 20 aa, Homo sapiens
THESHRIYVAIRAMDRNSLQ

SEQ ID NO: 239 - protein, 20 aa, Homo sapiens
RNPQQAGIREIFTFSPQIST

SEQ ID NO: 240 - protein, 21 aa, Homo sapiens
GQATSYEIRMSKSLQNIQDDF

SEQ ID NO: 241 - protein, 20 aa, Homo sapiens
ERKWGFSRVSSGGSFSVLGV

SEQ ID NO: 242 - protein, 20 aa, Homo sapiens
GSHAMYVPGYTANGNIQMNA

SEQ ID NO: 243 - protein, 20 aa, Homo sapiens
VNHSPSISTPAHSIPGSHAM

SEQ ID NO: 244 - protein, 20 aa, Homo sapiens
AVPPATVEAFVERDSLHFPH

SEQ ID NO: 245 - protein, 20 aa, Homo sapiens
KPGHWTYTLNNTHHSLQALK

SEQ ID NO: 246 - protein, 20 aa, Homo sapiens
NLTFRTASLWIPGTAKPGHW

SEQ ID NO: 247 - protein, 20 aa, Homo sapiens
LHFPHPVMIYANVKQGFYPI

SEQ ID NO: 248 - protein, 20 aa, Homo sapiens
PETGDPVTLRLLDDGAGADV

SEQ ID NO: 249 - protein, 20 aa, Homo sapiens
GFYPILNATVTATVEPETGD

SEQ ID NO: 250 - protein, 20 aa, Homo sapiens
FDPDGRKYYTNNFITNLTFR

SEQ ID NO: 251 - protein, 20 aa, Homo sapiens
LQALKVTVTSRASNSAVPPA

SEQ ID NO: 252 - protein, 153 aa, Homo sapiens
MASVRVAAYFENFLAAWRPVKASDGDYYTLAVPMGDVPMDGISVADIGAAVSSIFNSPEEFLGKAVGLSAEALTIQQYADVLSKALGKEVRDAKITPEAFEKLGFPAAKEIANMCRFYEMKPDRDVNLTHQLNPKVKSFSQFISENQGAFKGM

SEQ ID NO: 253 - DNA, 462 bp, Homo sapiens
atggccagtgtccgcgtggcggcctactttgaaaactttctcgcggcgtggcggcccgtgaaagcctctgatggagattactacaccttggctgtaccgatgggagatgtaccaatggatggtatctctgttgctgatattggagcagccgtctctagcatttttaattctccagaggaatttttaggcaaggccgtggggctcagtgcagaagcactaacaatacagcaatatgctgatgttttgtccaaggctttggggaaagaagtccgagatgcaaagattaccccggaagctttcgagaagctgggattccctgcagcaaaggaaatagccaatatgtgtcgtttctatgaaatgaagccagaccgagatgtcaatctcacccaccaactaaatcccaaagtcaaaagcttcagccagtttatctcagagaaccagggagccttcaagggcatgtag

SEQ ID NO: 254 - DNA, 8031 bp, Homo sapiens
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgcagcatcaccaccatcaccacggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaacgggactgagcttccacctcctcccacattctcgcttgtagaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataatgaattctgcagatatccatcacactggcggccgctcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 255 - DNA, 401 bp, Homo sapiens
  misc_feature 9, 67, 247, 275, 277, 397: n = A,T,C or G
gtggccagngactagaaggcgaggcgccgcgggaccatggcggcggcggcggacgagcggagtccanaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctanggacctgtgttatatttgaagaaaatgntnaacatgctgatacagaaggcaataataaaacagtgctaaaatataaatgccatacaatgaagaagctcagcatgacaagaactctcctgacagagaagaaggaaggagaagaaaacatangtgg

SEQ ID NO: 256 - DNA, 401 bp, Homo sapiens
  misc_feature 7, 37, 51, 79, 96, 98, 103, 104, 107, 116, 167, 181, 183,194, 206, 276, 303, 307, 308, 310, 323, 332, 341, 353, 374,376: n = A,T,C or G
tggtggncctgggatggggaaccgcggtggcttccgnggaggtttcggcantggcatccggggccggggtcgcggccgnggacggggccggggccnangccgnnganctcgcggangcaaggccgaggataaggagtggatgcccgtcaccaacttgggccgcttgnccaaggacatgaanancaagcccctgnaggagatctatntcttcttccctgccccattaaggaatcaagagatcatttgatttcttcctgggggcctctctcaaggatnaggtttttgaagattatgccagtgcanaaannanaccccgttgcccngtccatctncacccaacncttccaagggcnatttttgtttaggcctcattncnggggggaaccttaacccaatttggg

SEQ ID NO: 257 - DNA, 401 bp, Homo sapiens
  misc_feature 382, 387: n = A,T,C or G
atgtatgtaaaacacttcataaaatgtaaagggctataacaaatatgttataaagtgattctctcagccctgaggtatacagaatcatttgcctcagactgctgttggattttaaaatttttaaaatatctgctaagtaatttgctatgtcttctcccacactatcaatatgcctgcttctaacaggctccccactttcttttaatgtgctgttatgagctttggacatgagataaccgtgcctgttcagagtgtctacagtaagagctggacaaactctggagggacacagtctttgagacagctcttttggttgctttccacttttctgaaaggttcacagtaaccttctagataatagaaactcccagttaaagcctangctancaattttttttagt

SEQ ID NO: 258 - DNA, 401 bp, Homo sapiens
ggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagacccagatgctgaagcaaaattcagagagattgcagaagcatatgaaacactctcagatg

SEQ ID NO: 259 - DNA, 401 bp, Homo sapiens
attgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcg

SEQ ID NO: 260 - DNA, 363 bp, Homo sapiens
  misc_feature 7, 9, 19, 41, 63, 73, 106, 111, 113, 116, 119, 156, 158,162, 187, 247, 288, 289, 290, 292, 298, 299, 300, 340: n = A,T,C or G
aggagananggaggggganatgaatagggatggagaggganatagtggatgagcagggcacanggagaggaancagaaaggagaggcaagacagggagacacacancacananganganacaggtgggggctggggtggggcatggagagcctttnangtcncccaggccaccctgctctcgctggnctgttgaaacccactccatggcttcctgccactgcagttgggcccagggctggcttattnctggaatgcaagtggctgtggcttggagcctcccctctggnnnanggaaannnattgctcccttatctgcttggaatatctgagtttttccancccggaaataaaacacacacaca

SEQ ID NO: 261 - DNA, 401 bp, Homo sapiens
  misc_feature 114, 152: n = A,T,C or G
cggctctccgccgctctcccggggtttcggggcacttgggtcccacagtctggtcctgcttcaccttcccctgacctgagtagtcgccatggcacaggttctcagaggcactgngactgacttccctggatttgatgagcgggctgatgcanaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaa

SEQ ID NO: 262 - DNA, 401 bp, Homo sapiens
  misc_feature 7, 26, 258, 305, 358, 373, 374, 378: n = A,T,C or G
agtctanaacatttctaatattttgngctttcatatatcaaaggagattatgtgaaactatttttaaatactgtaaagtgacatatagttataagatatatttctgtacagtagagaaagagtttataacatgaagaatattgtaccattatacattttcattctcgatctcataagaaattcaaaagaataatgatagaggtgaaaatatgtttactttctctaaatcaagcctagttgtcaactcaaaaattatgntgcatagttttattttgaatttaggttttgggactacttttttccancttcaatgagaaaataaaatctacaactcaggagttactacagaagttctaantatttttttgctaannagcnaaaaatataaacatatgaaaatg

SEQ ID NO: 263 - DNA, 401 bp, Homo sapiens
  misc_feature 232, 290, 304, 326, 383: n = A,T,C or G
ctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccactgcggcaggcccaggagctgagtgggccccggccctcagcccgtcccgncggacccgctttcctcaactctccatcttctcctgccgaccgagatcgccgaggcggnctcaggctccctanccccttccccgtcccttccccncccccgtccccgccccgggggccgccgccacccgcctcccaccatggctctgaaganaatccacaaggaattgaa

SEQ ID NO: 264 - DNA, 401 bp, Homo sapiens
aacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctgtgaatctgaacctgtggtcttgggagccagggtgacctgatatgacatctaaagaagcttctggactctg

SEQ ID NO: 265 - DNA, 271 bp, Homo sapiens
  misc_feature 59: n = A,T,C or G
gccacttcctgtggacatgggcagagcgctgctgccagttcctggtagccttgaccacnacgctggggggtctttgtgatggtcatgggtctcatttgcacttgggggtgtgggattcaagttagaagtttctagatctggccgggcgcagtggctcacacctgtaatcccagcactttaggaggctgaggcaggcggatcatgaggtcaggagatcgagaccgtcctggctaacacagtgaaaccccgtctctactaaaaatacaaaaaa

SEQ ID NO: 266 - DNA, 401 bp, Homo sapiens
  misc_feature 45: n = A,T,C or G
attcataaatttagctgaaagatactgattcaatttgtatacagngaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgca

SEQ ID NO: 267 - DNA, 401 bp, Homo sapiens
  misc_feature 116, 247, 277, 296, 307, 313, 322, 323, 336, 342, 355, 365,377, 378, 397: n = A,T,C or G
gaagaggcatcacctgatcccggagacctttggagttaagaggcggcggaagcgagggcctgtggagtcggatcctcttcggggtgagccagggtcggcgcgcgcggctgtctcanaactcatgcagctgttcccgcgaggcctgtttgaggacgcgctgccgcccatcgtgctgaggagccaggtgtacagccttgtgcctgacaggaccgtggccgaccggcagctgaaggagcttcaagagcanggggagacaaaatcgtccagctgggcttcnacttggatgcccatggaanttattctttcncttganggacttacnngggacccaagaancccttncaaggggcccttngtggatgggncccgaaaccccnntatttgcccttgggggggnccaa

SEQ ID NO: 268 - DNA, 223 bp, Homo sapiens
tcgccatgttggccaggctggtcttgaactcctgactttaagtgatccacccgcctcaacctcccaaagtgctgggattacaggtgtgagccaccgcgcctggcctgatacatacttttagaatcaagtagtcacgcactttttctgttcatttttctaaaaagtaaatatacaaatgttttgttttttgttttttttgtttgtttgtttctgtttttttttt

SEQ ID NO: 269 - DNA, 401 bp, Homo sapiens
actatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccat

SEQ ID NO: 270 - DNA, 401 bp, Homo sapiens
  misc_feature 240, 382: n = A,T,C or G
tggctgttgattcacctcagcactgcttggtatctgcaccctacctctctttagaggctgccttgtcaactgaaaaatgcacctgacttcgagcaagactctttccttaggttctggatctgtttgagccccatggcactgagctggaatctgagggtcttgttccaaggatgtgatgatgtgggagaatgttctttgaaagagcagaaatccagtctgcatggaaacagcctgtagagnagaagtttccagtgataagtgttcactgttctaaggaggtacaccacagctacctgaattttcccaaaatgagtgcttctgtgcgttacaactggcctttgtacttgactgtgatgactttgttttttcttttcaattctanatgaacatgggaaaaaatg

SEQ ID NO: 271 - DNA, 329 bp, Homo sapiens
ccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaaaaaa

SEQ ID NO: 272 - DNA, 401 bp, Homo sapiens
  misc_feature 1, 7, 12, 21, 61, 62, 66, 72, 78, 88, 90, 92, 98, 117, 119,128, 130, 134, 142, 144, 151, 159, 162, 164, 168, 169, 177,184, 185, 188, 194, 202, 204, 209, 213, 218, 223, 231, 260,272, 299, 300, 306, 321, 322, 323, 331, 335, 336, 338: n = A,T,C or G
  misc_feature 341, 342, 343, 345, 346, 351, 358, 360, 362, 363, 387, 390,392: n = A,T,C or G
nggctgntaacntcggaggtnacttcctggactatcctggagaccccctccgcttccacgnncatnatatcnctcatngctgggcccntnangacacnatcccactccaacacctgngngatgctggncncctnggaaccancntcagaangaccctgntcntntgtnntccgcaanctgaagnnaangcgggntacacctncntgcantggnccacnctgcngggaactntacacacctacgggatgtggctgcgccangagccaagagcntttctggatgattccccagcctcttgnnagggantctacaacattgctnnntacctttntccnncngcnnntnntggantacaggngntnntaacactacatcttttttactgcnccntncttggtggg

SEQ ID NO: 273 - DNA, 401 bp, Homo sapiens
  misc_feature 399: n = A,T,C or G
cagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtattaacgtgtcagggctgagtgntc

SEQ ID NO: 274 - DNA, 401 bp, Homo sapiens
ccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgag

SEQ ID NO: 275 - DNA, 401 bp, Homo sapiens
ccacttccaccactttgtggagcagtgccttcagcgcaacccggatgccaggtatccctgctggcctgggcctgggcttcgggagagcagagggtgctcaggagggtaaggccagggtgtgaagggacttacctcccaaaggttctgcaggggaatctggagctacacacaggagggatcagctcctgggtgtgtcagaggccagcctggggagctctggccactgcttcccatgagctgagggagagggagaggggacccgaggctgaggcataagtggcaggatttcgggaagctggggacacggcagtgatgctgcggtctctcctcccctttccctccaggcccagtgccagcaccctcctgaaccactctttcttcaagcagatcaagcgacgtgc

SEQ ID NO: 276 - DNA, 401 bp, Homo sapiens
  misc_feature 11: n = A,T,C or G
tctgatattgntacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgatgatgaatcaagtagtgatgaaaccagtaatcagcccagtcctgcctttagacgacgccgtgctaggaagaagaccgtttctgcttcagaatctgaagaccggctagttggtgaacaagaaactgaaccttctaaggagttgagtaaacgtcagttcagtagtggtctcaataagtgtgttatacttgctttggtgattgcaatcagcatgggatttggccatttctatggcac

SEQ ID NO: 277 - DNA, 401 bp, Homo sapiens
  misc_feature 227, 333: n = A,T,C or G
aactttggcaacatatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagnggcgctcaaggatgatgcttcttgaaaattgcttagttgaaaaatggagagatcagcttagtaaaagatccatacagtgggaagagaggctgcaggaacagcgganaacagttcaggacaagaagaaaacagccgggcgcaccagtcgtagtaatccccccaaaccaaagggaa

SEQ ID NO: 278 - DNA, 401 bp, Homo sapiens
  misc_feature 322, 354: n = A,T,C or G
aatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagtctacctacgacaacaaanccctgtaagtgcaatgcttgtgctcgtgaagncattatcaggaccaagagaacatatcgtggacctggagatgctgaca

SEQ ID NO: 279 - DNA, 401 bp, Homo sapiens
  misc_feature 30, 35, 81, 88, 180, 212, 378, 384, 391: n = A,T,C or G
aaattattgcctctgatacatacctaagtnaacanaacattaatacctaagtaaacataacattacttggagggttgcagnttctaantgaaactgtatttgaaacttttaagtatactttaggaaacaagcatgaacggcagtctagaataccagaaacatctacttgggtagcttggngccattatcctgtggaatctgatatgtctggnagcatgtcattgatgggacatgaagacatctttggaaatgatgagattatttcctgtgttaaaaaaaaaaaaaatcttaaattcctacaatgtgaaactgaaactaataattttgatcctgatgtatgggacagcgtatctgtaccaggctctaaataacaaaagntagggngacaagnacatgttcct

SEQ ID NO: 280 - DNA, 326 bp, Homo sapiens
gaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcaaaaaaaaa

SEQ ID NO: 281 - DNA, 374 bp, Homo sapiens
caacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgg

SEQ ID NO: 282 - DNA, 404 bp, Homo sapiens
  misc_feature 26, 27, 51, 137, 180, 222: n = A,T,C or G
agtgtggtggaattcccgcatcctanncgccgactcacacaaggcagagtngccatggagaaaattccagtgtcagcattcttgctccttgtggccctctcctacactctggccagagataccacagtcaaacctgnagccaaaaaggacacaaaggactctcgacccaaactgccccanaccctctccagaggttggggtgaccaactcatctggactcanacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaaca

SEQ ID NO: 283 - DNA, 184 bp, Homo sapiens
  misc_feature 26: n = A,T,C or G
agtgtggtggaattcacttgcttaanttgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaa

SEQ ID NO: 284 - DNA, 421 bp, Homo sapiens
  misc_feature 147, 149: n = A,T,C or G
ctattaatcctgccacaatatttttaattacgtacaaagatctgacatgtcacccagggacccatttcacccactgctctgtttggccgccagtcttttgtctctctcttcagcaatggtgaggcggataccctttcctcggggaananaaatccatggtttgttgcccttgccaataacaaaaatgttggaaagtcgagtggcaaagctgttgccattggcatctttcacgtgaaccacgtcaaaagatccagggtgcctctctctgttggtgatcacaccaattcttcctaggttagcacctccagtcaccatacacaggttaccagtgtcgaacttgatgaaatcagtaatcttgccagtctctaaatcaatctgaatggtatcattcaccttgatgaggggatcggggtagcggatg

SEQ ID NO: 285 - DNA, 361 bp, Homo sapiens
  misc_feature 34, 188: n = A,T,C or G
ctgggtggtaactctttatttcattgtccggaanaaagatgggagtgggaacagggtggacactgtgcaggcttcagcttccactccgggcaggattcaggctatctgggaccgcagggactgccaggtgcacagccctggctcccgaggcaggcaggcaaggtgacgggactggaagcccttttcanagccttggaggagctggtccgtccacaagcaatgagtgccactctgcagtttgcaggggatggataaacagggaaacactgtgcattcctcacagccaacagtgtaggtcttggtgaagccccggcgctgagctaagctcaggctgttccagggagccacgaaactgcaggta

SEQ ID NO: 286 - DNA, 336 bp, Homo sapiens
  misc_feature 40, 68, 75, 127, 262: n = A,T,C or G
tttgagtggcagcgcctttatttgtgggggccttcaaggnagggtcgtggggggcagcggggaggaanagccganaaactgtgtgaccggggcctcaggtggtgggcattgggggctcctcttgcanatgcccattggcatcaccggtgcagccattggtggcagcgggtaccggtcctttcttgttcaacatagggtaggtggcagccacgggtccaactcgcttgaggctgggccctgggcgctccattttgtgttccangagcatgtggttctgtggcgggagccccacgcaggccctgaggatgttctcgatgcagctgcgctggcggaaaa

SEQ ID NO: 287 - DNA, 301 bp, Homo sapiens
  misc_feature 15, 33, 44, 53, 76, 83, 107, 117, 154, 166, 192, 194, 207,215, 241, 246: n = A,T,C or G
tgggtaccaaatttntttatttgaaggaatggnacaaatcaaanaacttaagnggatgttttggtacaacttatanaaaaggnaaaggaaaccccaacatgcatgcnctgccttggngaccagggaagtcaccccacggctatggggaaattancccgaggcttanctttcattatcactgtctcccagggngngcttgtcaaaaanatattccnccaagccaaattcgggcgctcccatnttgcncaagttggtcacgtggtcacccaattctttgatggctttcacctgctcattcagg

SEQ ID NO: 288 - DNA, 358 bp, Homo sapiens
  misc_feature 39, 143, 226: n = A,T,C or G
aagtttttaaactttttatttgcatattaaaaaaattgngcattccaataattaaaatcatttgaacaaaaaaaaaaatggcactctgattaaactgcattacagcctgcaggacaccttgggccagcttggttttactctanatttcactgtcgtcccaccccacttcttccaccccacttcttccttcaccaacatgcaagttctttccttccctgccagccanatagatagacagatgggaaaggcaggcgcggccttcgttgtcagtagttctttgatgtgaaaggggcagcacagtcatttaaacttgatccaacctctttgcatcttacaaagttaaacagctaaaagaagt

SEQ ID NO: 289 - DNA, 462 bp, Homo sapiens
  misc_feature 87, 141, 182, 220, 269, 327: n = A,T,C or G
ggcatcagaaatgctgtttatttctctgctgctcccaagctggctggcctttgcagaggagcagacaacagatgcatagttgggganaaagggaggacaggttccaggatagagggtgcaggctgagggaggaagggtaanaggaaggaaggccatcctggatccccacatttcagtctcanatgaggacaaagggactcccaagcccccaaatcatcanaaaacaccaaggagcaggaggagcttgagcaggccccagggagcctcanagccataccagccactgtctacttcccatcctcctctcccattccctgtctgcttcanaccacctcccagctaagccccagctccattcccccaatcctggcccttgccagcttgacagtcacagtgcctggaattccaccactgaggcttctcccagttggattaggacgtcgccctgttagcatgctgccc

SEQ ID NO: 290 - DNA, 481 bp, Homo sapiens
  misc_feature 44, 57, 122, 158, 304, 325, 352, 405: n = A,T,C or G
tactttcctaaactttattaaagaaaaaagcaataagcaatggnggtaaatctctanaacatacccaattttctgggcttcctcccccgagaatgtgacattttgatttccaaacatgccanaagtgtatggttcccaactgtactaaagtaggtganaagctgaagtcctcaagtgttcatcttccaacttttcccagtctgtggtctgtctttggatcagcaataattgcctgaacagctactatggcttcgttgatttttgtctgtagctctctgagctcctctatgtgcagcaatcgcanaatttgagcagcttcattaanaactgcatctcctgtgtcaaaaccaanaatatgtttgtctaaagcaacaggtaagccctcttttgtttgatttgccttancaactgcatcctgtgtcaggcgctcctgaaccaaaatccgaattgccttaagcattaccaggtaatcatcatgacg

SEQ ID NO: 291 - DNA, 381 bp, Homo sapiens
  misc_feature 79, 166, 187, 208, 219, 315: n = A,T,C or G
tcatagtaatgtaaaaccatttgtttaattctaaatcaaatcactttcacaacagtgaaaattagtgactggttaaggngtgccactgtacatatcatcattttctgactggggtcaggacctggtcctagtccacaagggtggcaggaggagggtggaggctaanaacacagaaaacacacaaaanaaaggaaagctgccttggcanaaggatgaggnggtgagcttgccgaaggatggtgggaagggggctccctgttggggccgagccaggagtcccaagtcagctctcctgccttacttagctcctggcanagggtgagtggggacctacgaggttcaaaatcaaatggcatttggccagcctggctttactaacag

SEQ ID NO: 292 - DNA, 371 bp, Homo sapiens
  misc_feature 32, 55, 72, 151, 189, 292: n = A,T,C or G
gaaaaaataatccgtttaattgaaaaacctgnaggatactattccactcccccanatgaggaggctgagganaccaaacccctacatcacctcgtagccacttctgatactcttcacgaggcagcaggcaaagacaattcccaaaacctcnacaaaagcaattccaagggctgctgcagctaccaccancacatttttcctcagccagcccccaatcttctccacacagccctccttatggatcgccttctcgttgaaattaatcccacagcccacagtaacattaatgcancaggagtcggggactcggttcttcgacatggaagggattttctcccaatctgtgtagttagcagccccacagcacttaa

SEQ ID NO: 293 - DNA, 361 bp, Homo sapiens
  misc_feature 75, 196, 222: n = A,T,C or G
gatttaaaagaaaacactttattgttcagcaattaaaagttagccaaatatgtatttttctccataatttattgngatgttatcaacatcaagtaaaatgctcattttcatcatttgcttctgttcatgttttcttgaacacgtcttcaattttccttccaaaatgctgcatgccacacttgaggtaacgaagcanaagtatttttaaacatgacagctaanaacattcatctacagcaacctatatgctcaatacatgccgcgtgatcctagtagttttttcacaaccttctacaagtttttggaaaacatctgttatgatgactttcatacaccttcacctcaaaggctttcttgcacc

SEQ ID NO: 294 - DNA, 391 bp, Homo sapiens
  misc_feature 26, 77, 96, 150, 203, 252, 254, 264, 276: n = A,T,C or G
tattttaaagtttaattatgattcanaaaaaatcgagcgaataactttctctgaaaaaatatattgactctgtatanaccacagttattggggganaagggctggtaggttaaattatcctattttttattctgaaaatgatattaatanaaagtcccgtttccagtctgattataaagatacatatgcccaaaatggctganaataaatacaacaggaaatgcaaaagctgtaaagctaagggcatgcaananaaaatctcanaatacccaaagnggcaacaaggaacgtttggctggaatttgaagttatttcagtcatctttgtctttggctccatgtttcaggatgcgtgtgaactcgatgtaattgaaattcccctttttatcaat

SEQ ID NO: 295 - DNA, 343 bp, Homo sapiens
  misc_feature 145, 174, 205, 232: n = A,T,C or G
ttcttttgttttattgataacagaaactgtgcataattacagatttgatgaggaatctgcaaataataaagaatgtgtctactgccagcaaaatacaattattccatgccctctcaacatacaaatatagagttcttcacaccanatggctctggtgtaacaaagccattttanatgtttaattgtgcttctacaaaaccttcanagcatgaggtagtttcttttacctacnatattttccacatttccattattacacttttagtgagctaaaatccttttaacatagcctgcggatgatctttcacaaaagccaagcctcatttacaaagggtttatttct

SEQ ID NO: 296 - DNA, 241 bp, Homo sapiens
  misc_feature 96, 98, 106, 185: n = A,T,C or G
ttcttggatattggttgtttttgtgaaaaagtttttgtttttcttctcagtcaactgaattatttctctactttgccctcctgatgcccacatgananaacttaanataatttctaacagcttccactttggaaaaaaaaaaaacctgttttcctcatggaaccccaggagttgaaagtggatanatcgctctcaaaatctaaggctctgttcagctttacattatgttacctgacgtttt

SEQ ID NO: 297 - DNA, 391 bp, Homo sapiens
  misc_feature 12, 130: n = A,T,C or G
gttgtggctganaatgctggagatgctcagttctctccctcacaaggtaggccacaaattcttggtggtgccctcacatctggggtcttcaggcaccagccatgcctgccgaggagtgctgtcaggacanaccatgtccgtgctaggcccaggcacagcccaaccactcctcatccaagtctctcccaggtttctggtcccgatgggcaaggatgacccctccagtggctggtaccccaccatcccactacccctcacatgctctcactctccatcaggtccccaatcctggcttccctcttcacgaactctcaaagaaaaggaaggataaaacctaaataaaccagacagaagcagctctggaaaagtacaaaaagacagccagaggtgt

SEQ ID NO: 298 - DNA, 321 bp, Homo sapiens
  misc_feature 14, 30, 76, 116, 201, 288, 301: n = A,T,C or G
caagccaaactgtntccagctttattaaanatactttccataaacaatcatggtatttcaggcaggacatgggcanacaatcgttaacagtatacaacaactttcaaactcccttnttcaatggactaccaaaaatcaaaaagccactataaaacccaatgaagtcttcatctgatgctctgaacagggaaagtttaaagngagggttgacatttcacatttagcatgttgtttaacaacttttcacaagccgaccctgactttcaggaagtgaaatgaaaatggcanaatttatctgaanatccacaatctaaaaatgga

SEQ ID NO: 299 - DNA, 401 bp, Homo sapiens
  misc_feature 104, 268, 347: n = A,T,C or G
tatcataaagagtgttgaagtttatttattatagcaccattgagacattttgaaattggaattggtaaaaaaataaaacaaaaagcatttgaattgtatttggnggaacagcaaaaaaagagaagtatcatttttctttgtcaaattatactgtttccaaacattttggaaataaataactggaattttgtcggtcacttgcactggttgacaagattagaacaagaggaacacatatggagttaaattttttttgttgggatttcanatagagtttggtttataaaaagcaaacagggccaacgtccacaccaaattcttgatcaggaccaccaatgtcatagggngcaatatctacaataggtagtctcacagccttgcgtgttcgatattcaaagact

SEQ ID NO: 300 - DNA, 188 bp, Homo sapiens
  misc_feature 48: n = A,T,C or G
tgaatgctttgtcatattaagaaagttaaagtgcaataatgtttgaanacaataagtggtggtgtatcttgtttctaataagataaacttttttgtctttgctttatcttattagggagttgtatgtcagtgtataaaacatactgtgtggtataacaggcttaataaattctttaaaaggaaaaaaa

SEQ ID NO: 301 - DNA, 291 bp, Homo sapiens
aagattttgttttattttattatggctagaaagacactgttatagccaaaatcggcaatgacactaaagaaatcctctgtgcttttcaatatgcaaatatatttcttccaagagttgccctggtgtgacttcaagagttcatgttaacttcttttctggaaacttccttttcttagttgttgtattcttgaagagcctgggccatgaagagcttgcctaagttttgggcagtgaactccttgatgttctggcagtaagtgtttatctggcctgcaatgagcagcgagtcca

SEQ ID NO: 302 - DNA, 341 bp, Homo sapiens
  misc_feature 25: n = A,T,C or G
tgatttttcataattttattaaatnatcactgggaaaactaatggttcgcgtatcacacaattacactacaatctgataggagtggtaaaaccagccaatggaatccaggtaaagtacaaaaacgccaccttttattgtcctgtcttatttctcgggaaggagggttctactttacacatttcatgagccagcagtggacttgagttacaatgtgtaggttccttgtggttatagctgcagaagaagccatcaaattcttgaggacttgacatctctcggaaagaagcaaactagtggatcccccgggctgcaggaattcgatatcaagcttatcgatacc

SEQ ID NO: 303 - DNA, 361 bp, Homo sapiens
  misc_feature 15, 27, 92, 124, 127, 183, 198, 244, 320: n = A,T,C or G
tgcagacagtaaatnaattttatttgngttcacagaacatactaggcgatctcgacagtcgctccgtgacagcccaccaacccccaaccctntacctcgcagccaccctaaaggcgacttcaanaanatggaaggatctcacggatctcattcctaatggtccgccgaagtctcacacagtanacagacggagttganatgctggaggatgcagtcacctcctaaacttacgacccaccaccanacttcatcccagccgggacgtcctcccccacccgagtcctccccatttcttctcctactttgccgcagttccaggngtcctgcttccaccagtcccacaaagctcaataaataccaa

SEQ ID NO: 304 - DNA, 301 bp, Homo sapiens
  misc_feature 23, 104, 192: n = A,T,C or G
ctctttacaacagcctttatttncggcccttgatcctgctcggatgctggtggaggcccttagctccgcccgccaggctctgtgccgcctccccgcaggcgcanattcatgaacacggtgctcaggggcttgaggccgtactcccccagcgggagctggtcctccaggggcttcccctcgaaggtcagccanaacaggtcgtcctgcacaccctccagcccgctcacttgctgcttcaggtgggccacggtctgcgtcagccgcacctcgtaggtgctgctgcggcccttgttattcctca

SEQ ID NO: 305 - DNA, 331 bp, Homo sapiens
  misc_feature 3, 36, 60, 193, 223: n = A,T,C or G
ganaggctagtaacatcagttttattgggttggggnggcaaccatagcctggctgggggnggggctggccctcacaggttgttgagttccagcagggtctggtccaaggtctggtgaatctcgacgttctcctccttggcactggccaaggtctcttctaggtcatcgatggttttctccaactttgccacanacctctcggcaaactctgctcgggtctcancctccttcagcttctcctccaacagtttgatctcctcttcatatttatcttctttgggggaatactcctcctctgaggccatcagggacttgagggcctggtccatgg

SEQ ID NO: 306 - DNA, 457 bp, Homo sapiens
aatatgtaaaggtaataacttttattatattaaagacaatgcaaacgaaaaacagaattgagcagtgcaaaatttaaaggactgttttgttctcaaagttgcaagtttcaaagccaaaagaattatatgtatcaaatatataagtaaaaaaaagttagactttcaagcctgtaatcccagcactttgggaggctgaggcaggtggatcactaacattaaaaagacaacattagattttgtcgatttatagcaattttataaatatataactttgtcacttggatcctgaagcaaaataataaagtgaatttgggatttttgtacttggtaaaaagtttaacaccctaaattcacaactagtggatcccccgggctgcaggaattcgatatcaagcttatcgataccgtcgacctcgagggggggcccggtacccaattcgccctatagtgagtcgta

SEQ ID NO: 307 - DNA, 491 bp, Homo sapiens
gtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaa

SEQ ID NO: 308 - DNA, 421 bp, Homo sapiens
ctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttcc

SEQ ID NO: 309 - DNA, 321 bp, Homo sapiens
accaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgagg

SEQ ID NO: 310 - DNA, 381 bp, Homo sapiens
ttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggcttttttttttttcctccagggagaaggggagaaatgtacttggaaattaatgtatgtttacatctctttgcaaattcctgtacatagagatatattttttaagtgtgaatgtaacaacatactgtgaa

SEQ ID NO: 311 - DNA, 538 bp, Homo sapiens
tttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaa

SEQ ID NO: 312 - DNA, 176 bp, Homo sapiens
ggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaag

SEQ ID NO: 313 - DNA, 396 bp, Homo sapiens
ccagcacccccaggccctgggggacctgggttctcagactgccaaagaagccttgccatctggcgctcccatggctcttgcaacatctccccttcgtttttgagggggtcatgccgggggagccaccagcccctcactgggttcggaggagagtcaggaagggccaagcacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtgggg

SEQ ID NO: 314 - DNA, 311 bp, Homo sapiens
cctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcg

SEQ ID NO: 315 - DNA, 336 bp, Homo sapiens
tttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagt

SEQ ID NO: 316 - DNA, 436 bp, Homo sapiens
aacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatca

SEQ ID NO: 317 - DNA, 196 bp, Homo sapiens
tattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctccccca

SEQ ID NO: 318 - DNA, 381 bp, Homo sapiens
  misc_feature 8, 9, 102, 122, 167, 182, 193, 235, 253, 265, 266, 290, 321,378: n = A,T,C or G
gacgcttnngccgtaacgatgatcggagacatcctgctgttcgggacgttgctgatgaatgccggggcggtgctgaactttaagctgaaaaagaaggacacncagggctttggggaggagtncagggagcccaacacaggtgacaacatccgggaattcttgctgancctcagatactttcnaatcttcatcnccctgtggaacatcttcatgatgttctgcatgattgtgctgntcggctcttgaatcccancgatgaaaccannaactcactttcccgggatgccgantctccattcctccattcctgatgacttcaanaatgtttttgaccaaaaaaccgacaaccttcccagaaagtccaagctcgtggtgggngga

SEQ ID NO: 319 - DNA, 506 bp, Homo sapiens
ctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctt

SEQ ID NO: 320 - DNA, 351 bp, Homo sapiens
ctgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaa

SEQ ID NO: 321 - DNA, 421 bp, Homo sapiens
ctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgc

SEQ ID NO: 322 - DNA, 521 bp, Homo sapiens
agcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttt

SEQ ID NO: 323 - DNA, 435 bp, Homo sapiens
ccgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaa

SEQ ID NO: 324 - DNA, 521 bp, Homo sapiens
aggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaac

SEQ ID NO: 325 - DNA, 451 bp, Homo sapiens
attttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttga

SEQ ID NO: 326 - DNA, 421 bp, Homo sapiens
  misc_feature 296: n = A,T,C or G
cgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagantcactacaagaaaaactccttgtggtgaaggttctaagacgtgggatcgtttccagatgagaattcacaagcgactcattgacttgcacagtccttctgagattgttaagcagattacttccatc

SEQ ID NO: 327 - DNA, 456 bp, Homo sapiens
atcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaat

SEQ ID NO: 328 - DNA, 471 bp, Homo sapiens
gtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttcca

SEQ ID NO: 329 - DNA, 278 bp, Homo sapiens
  misc_feature 154, 204: n = A,T,C or G
gtttaaacttaagcttggtaccgagctcggatccactagtccagtgtggtggaattctagaaattgagatgcccccccaggccagcaaatgttcctttttgttcaaagtctatttttattccttgatatttttcttttttttttttttttttgnggatggggacttgtgaatttttctaaaggtgctatttaacatgggagganagcgtgtgcggctccagcccagcccgctgctcactttccaccctctctccacctgcctctggcttctcaggcct

SEQ ID NO: 330 - DNA, 338 bp, Homo sapiens
ctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacctaaaaaa

SEQ ID NO: 331 - DNA, 2820 bp, Homo sapiens
tggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcggaacggctcctcgtccaccagtccctataacacagaccacgcgcagaacagcgtcacggcgccctcgccctacgcacagcccagccccaccttcgatgctctctctccatcacccgccatcccctccaacaccgactacccaggcccgcacagttccgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgagttcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgcgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacggtcctctttagtttttggttgggaatgaggaaaattcttaaaaggcccatagcagccagttcaaaaacacccgacgtcatgtatttgagcatatcagtaacccccttaaatttaatacccagataccttatcttacaatgttgattgggaaaacatttgctgcccattacagaggtattaaaactaaatttcactactagattgactaactcaaatacacatttgctactgttgtaagaattc

SEQ ID NO: 332 - DNA, 2270 bp, Homo sapiens
tcgttgatatcaaagacagttgaaggaaatgaattttgaaacttcacggtgtgccaccctacagtactgccctgacccttacatccagcgtttcgtagaaacccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatccaacagattgcagcattgtcggtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaa

SEQ ID NO: 333 - DNA, 2816 bp, Homo sapiens
tcgttgatatcaaagacagttgaaggaaatgaattttgaaacttcacggtgtgccaccctacagtactgccctgacccttacatccagcgtttcgtagaaacccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggtttaaaagaaa

SEQ ID NO: 334 - DNA, 2082 bp, Homo sapiens
agatgctacagcgactgcacacccaggctgtatgatacagcctattgctcccgggctgcaaacctgtccagcatgtgatgtggtgggatactgaattgaataccgaatactgtaggcaattgtaacacagtggtaagtctttgtgtatctaaacatagctaaacaccaaaaggtatagtaagaatatggtattataatcttatggaactatcattgtatatgtggtttgtcaaccagaatgtagttatacagcacaggactgtgcttatgatgtgccaagcacagctctcagtactaactcctttaatcttcatatcaaccctaggaggtaacttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtctcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagtgagtgtatcaacgtgtcattttaggaggcatgagtgacggtgactttatttggatcagcaatagggtgattgatgagcaatgtggaacataatgggagatagcagattgtcatagattcagatgacctggtatggcaaccctctttcagttgcaaccttttttacgtgtcttattataaccttcccttcagaattccacttatgttctgaaattaaatacaaaccatttctggtgaattacaaagaaactcacactaacagttctcttctctatatgcctggtccatacacactaacagtaagtacacactctatttggtagtgatgtgtatatttgaaaacatgaaatcttttctcatcccaatggattgtcttataaatctcctgggatgcacactatccacttttgggaataacactgtagaccagggatagcaaataggctttactataatataaagtgacttgtttgaatgctgtaatgagaagaattctgagacctagtgcatgataattggggaaatatctgggtgcagaaggataaggtagcatcatgttgccgtattttagcatctctg

SEQ ID NO: 335 - DNA, 4849 bp, Homo sapiens
cgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccagtgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagcyccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatattttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaataaa

SEQ ID NO: 336 - DNA, 1386 bp, Homo sapiens
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctga

SEQ ID NO: 337 - DNA, 1551 bp, Homo sapiens
atgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctga

SEQ ID NO: 338 - protein, 586 aa, Homo sapiens [sequence omitted]

SEQ ID NO: 339 - protein, 641 aa, Homo sapiens [sequence omitted]

SEQ ID NO: 340 - protein, 448 aa, Homo sapiens
MSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 341 - protein, 356 aa, Homo sapiens [sequence omitted]

SEQ ID NO: 342 - protein, 680 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSQCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 343 - protein, 461 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 344 - protein, 516 aa, Homo sapiens
MSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 345 - DNA, 1800 bp, Homo sapiens
gcgcctcattgccactgcagtgactaaagctgggaagacgctggtcagttcacctgccccactggttgttttttaaacaaattctgatacaggcgacatcctcactgaccgagcaaagattgacattcgtatcatcactgtgcaccattggcttctaggcactccagtggggtaggagaaggaggtctgaaaccctcgcagagggatcttgccctcattctttgggtctgaaacactggcagtcgttggaaacaggactcagggataaaccagcgcaatggattgggggacgctgcacactttcatcgggggtgtcaacaaacactccaccagcatcgggaaggtgtggatcacagtcatctttattttccgagtcatgatcctagtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcacaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaaacatttcaaggtaaaatgtagctgcgtcataaggagacttctgtcttctccagaaggcaataccaacctgaaagttccttctgtagcctgaagagtttgtaaatgactttcataataaatagacacttgagttaactttttgtaggatacttgctccattcatacacaacgtaatcaaatatgtggtccatctctgaaaacaagagactgcttgacaaaggagcattgcagtcactttgacaggttccttttaagtggactctctgacaaagtgggtactttctgaaaatttatataactgttgttgataaggaacatttatccaggaattgatacgtttattaggaaaagatatttttataggcttggatgtttttagttccgactttgaatttatataaagtatttttataatgactggtcttccttacctggaaaaacatgcgatgttagttttagaattacaccacaagtatctaaatttccaacttacaaagggtcctatcttgtaaatattgttttgcattgtctgttggcaaatttgtgaactgtcatgatacgcttaaggtgggaaagtgttcattgcacaatatatttttactgctttctgaatgtagacggaacagtgtggaagcagaaggcttttttaactcatccgtttggccgatcgttgcagaccactgggagatgtggatgtggttgcctccttttgctcgtccccgtggcttaacccttct

SEQ ID NO: 346 - protein, 261 aa, Homo sapiens
MDWGTLHTFIGGVNKHSTSIGKVWITVIFIFRVMILVVAAQEVWGDEQEDFVCNTLQPGCKNVCYDHFFPVSHIRLWALQLIFVSTPALLVAMHVAYYRHETTRKFRRGEKRNDFKDIEDIKKHKVRIEGSLWWTYTSSIFFRIIFEAAFMYVFYFLYNGYHLPWVLKCGIDPCPNLVDCFISRPTEKTVFTIFMISASVICMLLNVAELCYLLLKVCFRRSKRAQTQKNHPNHALKESKQNEMNELISDSGQNAITGFPS

SEQ ID NO: 347 - DNA, 1740 bp, Homo sapiens
atgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaacggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaa

SEQ ID NO: 348 - protein, 579 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDETAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 349 - DNA, 207 bp, Homo sapiens
atgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagattt

SEQ ID NO: 350 - protein, 69 aa, Homo sapiens
MWQPLFFKWLLSCCPGSSQIAAAASTQPEDDINTQRKKSQEKMREVTDSPGRPRELTIPQTSSHGANRF

SEQ ID NO: 351 - DNA, 1012 bp, Homo sapiens
ccctctagaaataattttgtttaactttaagaaggagatatacatatgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattcatggattgggggacgctgcacactttcatcgggggtgtcaacaaacactccaccagcatcgggaaggtgtggatcacagtcatctttattttccgagtcatgatcctcgtggtggctgcccaggaagtgtggggtgacgagcaagaggacttcgtctgcaacacactgcaaccgggatgcaaaaatgtgtgctatgaccactttttcccggtgtcccacatccggctgtgggccctccagctgatcttcgtctccaccccagcgctgctggtggccatgcatgtggcctactacaggcacgaaaccactcgcaagttcaggcgaggagagaagaggaatgatttcaaagacatagaggacattaaaaagcagaaggttcggatagaggggtgactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 352 - protein, 267 aa, Homo sapiens
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFMDWGTLHTFIGGVNKHSTSIGKVWITVIFIFRVMILVVAAQEVWGDEQEDFVCNTLQPGCKNVCYDHFFPVSHIRLWALQLIFVSTPALLVAMHVAYYRHETTRKFRRGEKRNDFKDIEDIKKQKVRIEG

SEQ ID NO: 353 - DNA, 900 bp, Homo sapiens
atgcatcaccatcaccatcacacggccgcgtccgataacttccagctgtcccagggtgggcagggattcgccattccgatcgggcaggcgatggcgatcgcgggccagatcaagcttcccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggccgaattccacgaaaccactcgcaagttcaggcgaggagagaagaggaatgatttcaaagacatagaggacattaaaaagcagaaggttcggatagaggggtcgctgtggtggacgtacaccagcagcatctttttccgaatcatctttgaagcagcctttatgtatgtgttttacttcctttacaatgggtaccacctgccctgggtgttgaaatgtgggattgacccctgccccaaccttgttgactgctttatttctaggccaacagagaagaccgtgtttaccatttttatgatttctgcgtctgtgatttgcatgctgcttaacgtggcagagttgtgctacctgctgctgaaagtgtgttttaggagatcaaagagagcacagacgcaaaaaaatcaccccaatcatgccctaaaggagagtaagcagaatgaaatgaatgagctgatttcagatagtggtcaaaatgcaatcacaggtttcccaagctaa

SEQ ID NO: 354 - protein, 299 aa, Homo sapiens
MHHHHHHTAASDNFQLSQGGQGFAIPIGQAMAIAGQIKLPTVHIGPTAFLGLGVVDNNGNGARVQRVVGSAPAASLGISTGDVITAVDGAPINSATAMADALNGHHPGDVISVTWQTKSGGTRTGNVTLAEGPPAEFHETTRKFRRGEKRNDFKDIEDIKKQKVRIEGSLWWTYTSSIFFRIIFEAAFMYVFYFLYNGYHLPWVLKCGIDPCPNLVDCFISRPTEKTVFTIFMISASVICMLLNVAELCYLLLKVCFRRSKRAQTQKNHPNHALKESKQNEMNELISDSGQNAITGFPS

SEQ ID NO: 355 - DNA, 24 bp, Artificial Sequence
  PCR primer
ggagtacagcttcaagacaatggg

SEQ ID NO: 356 - DNA, 31 bp, Artificial Sequence
  PCR primer
ccatgggaattcattataataattttgttcc

SEQ ID NO: 357 - protein, 920 aa, Homo sapiens
MQHHHHHHGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVEAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 358 - DNA, 2773 bp, Homo sapiens
catatgcagcatcaccaccatcaccacggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaacgggactgagcttccacctcctcccacattctcgcttgtagaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataatgaattc

SEQ ID NO: 359 - DNA, 25 bp, Artificial Sequence
  PCR primer
tggcagcccctcttcttcaagtggc

SEQ ID NO: 360 - DNA, 33 bp, Artificial Sequence
  PCR primer
cgccagaattcatcaaacaaatctgttagcacc

SEQ ID NO: 361 - protein, 77 aa, Homo sapiens
MQHHHHHHWQPLFFKWLLSCCPGSSQIAAAASTQPEDDINTQRKKSQEKMREVTDSPGRPRELTIPQTSSHGANRFV

SEQ ID NO: 362 - DNA, 244 bp, Homo sapiens
catatgcagcatcaccaccatcaccactggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgtttgatgaattc

SEQ ID NO: 363 - protein, 20 aa, Homo sapiens
MWQPLFFKWLLSCCPGSSQI

SEQ ID NO: 364 - DNA, 60 bp, Homo sapiens
atgtggcagcccctcttcttcaagtggctcttgtcctgttgccctgggagttctcaaatt

SEQ ID NO: 365 - protein, 20 aa, Homo sapiens
GSSQIAAAASTQPEDDINTQ

SEQ ID NO: 366 - DNA, 60 bp, Homo sapiens
gggagttctcaaattgctgcagcagcctccacccagcctgaggatgacatcaatacacag

SEQ ID NO: 367 - protein, 20 aa, Homo sapiens
KPGHWTYTLNNTHHSLQALK

SEQ ID NO: 368 - DNA, 2343 bp, Homo sapiens
attccggagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaatt

SEQ ID NO: 369 - protein, 708 aa, Homo sapiens
MATTAELFEEPFVADEYIERLVWRTPGGGSRGGPEAFDPKRLLEEFVNHIQELQIMDERIQRKVEKLEQQCQKEAKEFAKKVQELQKSNQVAFQHFQELDEHISYVATKVCHLGDQLEGVNTPRQRAVEAQKLMKYFNEFLDGELKSDVFTNSEKIKEAADIIQKLHLIAQELPFDRFSEVKSKIASKYHDLECQLIQEFTSAQRRGEISRMREVAAVLLHFKGYSHCVDVYIKQCQEGAYLRNDIFEDAGILCQRVNKQVGDIFSNPETVLAKLIQNVFEIKLQSFVKEQLEECRKSDAEQYLKNLYDLYTRTTNLSSKLMEFNLGTDKQTFLSKLIKSIFISYLENYIEVETGYLKSRSAMILQRYYDSKNHQKRSIGTGGIQDLKERIRQRTNLPLGPSIDTHGETFLSQEVVVNLLQETKQAFERCHRLSDPSDLPRNAFRIFTILVEFLCIEHIDYALETGLAGIPSSDSRNANLYFLDVVQQANTIFHLFDKQFNDHLMPLISSSPKLSECLQKKKEIIEQMEMKLDTGIDRTLNCMIGQMKHILAAEQKKTDFKPEDENNVLIQYTNACVKVCAYVRKQVEKIKNSMDGKNVDTVLMELGVRFHRLIYEHLQQYSYSCMGGMLAICDVAEYRKCAKDFKIPMVLHLFDTLHALCNLLVVAPDNLKQVCSGEQLANLDKNILHSFVQLRADYRSARLARHFS

SEQ ID NO: 370 - DNA, 60 bp, Homo sapiens
gtcaatcactctcccagcataagcaccccagcccactctattccagggagtcatgctatg

SEQ ID NO: 371 - DNA, 60 bp, Homo sapiens
agtagaatttcctctggaactggagacattttccagcaacatattcagcttgaaagtaca

SEQ ID NO: 372 - DNA, 60 bp, Homo sapiens
ccagagactggagatcctgttacgctgagactccttgatgatggagcaggtgctgatgtt

SEQ ID NO: 373 - DNA, 60 bp, Homo sapiens
ttacagtctgctgtatctaacattgcccaggcgcctctgtttattccccccaattctgat

SEQ ID NO: 374 - DNA, 60 bp, Homo sapiens
gctgtgcccccagccactgtggaagcctttgtggaaagagacagcctccattttcctcat

SEQ ID NO: 375 - DNA, 60 bp, Homo sapiens
aaaaacacagtgactgtggataatactgtgggcaacgacactatgtttctagttacgtgg

SEQ ID NO: 376 - protein, 20 aa, Homo sapiens
LQSAVSNIAQAPLFIPPNSD

SEQ ID NO: 377 - protein, 20 aa, Homo sapiens
VNHSPSISTPAHSIPGSHAM

SEQ ID NO: 378 - protein, 20 aa, Homo sapiens
PETGDPVTLRLLDDGAGADV

SEQ ID NO: 379 - protein, 20 aa, Homo sapiens
AVPPATVEAFVERDSLHFPH

SEQ ID NO: 380 - protein, 20 aa, Homo sapiens
SRISSGTGDIFQQHIQLEST

SEQ ID NO: 381 - protein, 20 aa, Homo sapiens
KNTVTVDNTVGNDTMFLVTW

SEQ ID NO: 382 - protein, 20 aa, Homo sapiens
KPGHWTYTLNNTHHSLQALK

SEQ ID NO: 383 - DNA, 29 bp, Artificial Sequence
  PCR primer
cggcgaattcatggattgggggacgctgc

SEQ ID NO: 384 - DNA, 35 bp, Artificial Sequence
  PCR primer
cggcctcgagtcacccctctatccgaaccttctgc

SEQ ID NO: 385 - DNA, 32 bp, Artificial Sequence
  PCR primer
cggcgaattccacgaaccactcgcaagttcag

SEQ ID NO: 386 - DNA, 30 bp, Artificial Sequence
  PCR primer
cggctcgagttagcttgggcctgtgattgc

SEQ ID NO: 387 - protein, 20 aa, Homo sapiens
FFKWLLSCCPGSSQIAAAAS

SEQ ID NO: 388 - protein, 19 aa, Homo sapiens
LSCCPGSSQIAAASTQPED

SEQ ID NO: 389 - protein, 20 aa, Homo sapiens
AAAASTQPEDDINTQRKKSQ

SEQ ID NO: 390 - protein, 20 aa, Homo sapiens
TQPEDDINTQRKKSQEKMRE

SEQ ID NO: 391 - protein, 20 aa, Homo sapiens
DINTQRKKSQEKMREVTDSP

SEQ ID NO: 392 - protein, 20 aa, Homo sapiens
RKKSQEKMREVTDSPGRPRE

SEQ ID NO: 393 - protein, 20 aa, Homo sapiens
EKMREVTDSPGRPRELTIPQ

SEQ ID NO: 394 - protein, 20 aa, Homo sapiens
VTDSPGRPRELTIPQTSSHG

SEQ ID NO: 395 - protein, 19 aa, Homo sapiens
GRPRELTIPQTSSHGANRF

SEQ ID NO: 396 - protein, 19 aa, Homo sapiens
MNKLYIGNLSENAAPSDLE

SEQ ID NO: 397 - protein, 20 aa, Homo sapiens
SENAAPSDLESIFKDAKIPV

SEQ ID NO: 398 - protein, 20 aa, Homo sapiens
SIFKDAKIPVSGPFLVKTGY

SEQ ID NO: 399 - protein, 20 aa, Homo sapiens
SGPFLVKTGYAFVDCPDESW

SEQ ID NO: 400 - protein, 20 aa, Homo sapiens
AFVDCPDESWALKAIEALSG

SEQ ID NO: 401 - protein, 20 aa, Homo sapiens
ALKAIEALSGKIELHGKPIE

SEQ ID NO: 402 - protein, 20 aa, Homo sapiens
KIELHGKPIEVEHSVPKRQR

SEQ ID NO: 403 - protein, 20 aa, Homo sapiens
VEHSVPKRQRIRKLQIRNIP

SEQ ID NO: 404 - protein, 20 aa, Homo sapiens
IRKLQIRNIPPHLQWEVLDS

SEQ ID NO: 405 - protein, 20 aa, Homo sapiens
AVVNVTYSSKDQARQALDKL

SEQ ID NO: 406 - protein, 20 aa, Homo sapiens
DQARQALDKLNGFQLENFTL

SEQ ID NO: 407 - protein, 20 aa, Homo sapiens
NGFQLENFTLKVAYIPDETA

SEQ ID NO: 408 - protein, 20 aa, Homo sapiens
KVAYIPDETAAQQNPLQQPR

SEQ ID NO: 409 - protein, 20 aa, Homo sapiens
AQQNPLQQPRGRRGLGQRGS

SEQ ID NO: 410 - protein, 20 aa, Homo sapiens
GRRGLGQRGSSRQGSPGSVS

SEQ ID NO: 411 - protein, 20 aa, Homo sapiens
SRQGSPGSVSKQKPCDLPLR

SEQ ID NO: 412 - protein, 20 aa, Homo sapiens
KQKPCDLPLRLLVPTQFVGA

SEQ ID NO: 413 - protein, 20 aa, Homo sapiens
LLVPTQFVGAIIGKEGATIR

SEQ ID NO: 414 - protein, 20 aa, Homo sapiens
IIGKEGATIRNITKQTQSKI

SEQ ID NO: 415 - protein, 20 aa, Homo sapiens
NITKQTQSKIDVHRKENAGA

SEQ ID NO: 416 - protein, 20 aa, Homo sapiens
DVHRKENAGAAEKSITILST

SEQ ID NO: 417 - protein, 20 aa, Homo sapiens
AEKSITILSTPEGTSAACKS

SEQ ID NO: 418 - protein, 20 aa, Homo sapiens
PEGTSAACKSILEIMHKEAQ

SEQ ID NO: 419 - protein, 20 aa, Homo sapiens
ILEIMHKEAQDIKFTEEIPL

SEQ ID NO: 420 - DNA, 455 bp, Homo sapiens
gaagacatgcttacttccccttcaccttccttcatgatgtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactgg

SEQ ID NO: 421 - DNA, 24 bp, Artificial Sequence
  PCR primer
actagtgtccgcgtggcggcctac

SEQ ID NO: 422 - DNA, 34 bp, Artificial Sequence
  PCR primer
catgagaattcatcacatgcccttgaaggctccc

SEQ ID NO: 423 - protein, 161 aa, Homo sapiens
MQHHHHHHHTSVRVAAYFENFLAAWRPVKASDGDYYTLAVPMGDVPMDGISVADIGAAVSSIFNSPEEFLGKAVGLSAEALTIQQYADVLSKALGKEVRDAKITPEAFEKLGFPAAKEIANMCRFYEMKPDRDVNLTHQLNPKVKSFSQFISENQGAFKGM

SEQ ID NO: 424 - DNA, 489 bp, Homo sapiens
atgcagcatcaccaccatcaccaccacactagtgtccgcgtggcggcctactttgaaaactttctcgcggcgtggcggcccgtgaaagcctctgatggagattactacaccttggctgtaccgatgggagatgtaccaatggatggtatctctgttgctgatattggagcagccgtctctagcatttttaattctccagaggaatttttaggcaaggccgtggggctcagtgcagaagcactaacaatacagcaatatgctgatgttttgtccaaggctttggggaaagaagtccgagatgcaaagattaccccggaagctttcgagaagctgggattccctgcagcaaaggaaatagccaatatgtgtcgtttctatgaaatgaagccagaccgagatgtcaatctcacccaccaactaaatcccaaagtcaaaagcttcagccagtttatctcagagaaccagggagccttcaagggcatgtgatga

SEQ ID NO: 425 - DNA, 32 bp, Artificial Sequence
  PCR primer
aacaaactgtatatcggaaacctcagcgagaa

SEQ ID NO: 426 - DNA, 33 bp, Artificial Sequence
  PCR primer
ccatagaattcattacttccgtcttgactgagg

SEQ ID NO: 427 - protein, 586 aa, Homo sapiens
MQHHHHHHNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDETAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 428 - DNA, 1764 bp, Homo sapiens
atgcagcatcaccaccatcaccacaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaacggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaatga

SEQ ID NO: 429 - DNA, 35 bp, Artificial Sequence
  PCR primer
ccatggaattcattatttcaatataagataatctc

SEQ ID NO: 430 - protein, 881 aa, Homo sapiens
MQHHHHHHGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVEAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILK

SEQ ID NO: 431 - DNA, 2646 bp, Homo sapiens
atgcagcatcaccaccatcaccacggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaacgggactgagcttccacctcctcccacattctcgcttgtagaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaataa

SEQ ID NO: 432 - DNA, 36 bp, Artificial Sequence
  PCR primer
cgcctgctcgagtcattaatattcatcagaaaatgg

SEQ ID NO: 433 - protein, 371 aa, Homo sapiens [sequence omitted]

SEQ ID NO: 434 - DNA, 1119 bp, Homo sapiens
atgcagcatcaccaccatcaccactggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaatga

SEQ ID NO: 435 - DNA, 36 bp, Artificial Sequence
  Primer
ggatccgccgccaccatgacatccattcgagctgta

SEQ ID NO: 436 - DNA, 27 bp, Artificial Sequence
  Primer
gtcgactcagctggaccacagccgcag

SEQ ID NO: 437 - DNA, 37 bp, Artificial Sequence
  Primer
ggatccgccgccaccatggactcctggaccttctgct

SEQ ID NO: 438 - DNA, 27 bp, Artificial Sequence
  Primer
gtcgactcagaaatcctttctcttgac

SEQ ID NO: 439 - DNA, 933 bp, Homo sapiens
atggactcctggaccttctgctgtgtgtccctttgcatcctggtagcaaagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagttggagcaaacactgaagctttctttggacaaggcaccagactcacagttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctga

SEQ ID NO: 440 - DNA, 822 bp, Homo sapiens
atgacatccattcgagctgtatttatattcctgtggctgcagctggacttggtgaatggagagaatgtggagcagcatccttcaaccctgagtgtccaggagggagacagcgctgttatcaagtgtacttattcagacagtgcctcaaactacttcccttggtataagcaagaacttggaaaaagacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagtatactgaacaccggtaaccagttctattttgggacagggacaagtttgacggtcattccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 441 - DNA, 2311 bp, Homo sapiens
gatttaatcctatgacaaactaagttggttctgtcttcacctgttttggtgaggttgtgtaagagttggtgtttgctcaggaagagatttaagcatgcttgcttacccagactcagagaagtctccctgttctgtcctagctatgttcctgtgttgtgtgcattcgtcttttccagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccagcccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgccagcatttcccaacacaaagattctgaccttaaatgcaaccatttgaaacccctgtaggcctcaggtgaaactccagatgccacaatgagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagagaggctgtctgttgtattcattgtggtcatagcacctaacaacattgtagcctcaatcgagtgagacagactagaagttcctagttggcttatgatagcaaatggcctcatgtcaaatattagatgtaattttgtgtaagaaatacagactggatgtaccaccaactactacctgtaatgacaggcctgtccaacacatctcccttttccatgctgtggtagccagcatcggaaagaacgctgatttaaagaggtgagcttgggaattttattgacacagtaccatttaatggggagacaaaaatgggggccaggggagggagaagtttctgtcgttaaaaacgagtttggaaagactggactctaaattctgttgattaaagatgagctttgtctaccttcaaaagtttgtttggcttacccccttcagcctccaattttttaagtgaaaatataactaataacatgtgaaaagaatagaagctaaggtttagataaatattgagcagatctataggaagattgaacctgaatattgccattatgcttgacatggtttccaaaaaatggtactccacatacttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataat

SEQ ID NO: 442 - protein, 226 aa, Homo sapiens
MDWGTLQTILGGVNKHSTSIGKIWLTVLFIFRIMILVVAAKEVWGDEQADFVCNTLQPGCKNVCYDHYFPISHIRLWALQLIFVSSPALLVAMHVAYRRHEKKRKFIKGEIKSEFKDIEEIKTQKVRIEGSLWWTYTSSIFFRVIFEAAFMYVFYVMYDGFSMQRLVKCNAWPCPNTVDCFVSRPTEKTVFTVFMIAVSGICILLNVTELCYLLIRYCSGKSKKPV

SEQ ID NO: 443 - protein, 23 aa, Homo sapiens
VKLCGIDPCPNLVDCFISRPGCG

SEQ ID NO: 444 - DNA, 36 bp, Artificial Sequence
  PCR primer
caatcaggcatgcacaacaaactgtatatcggaaac

SEQ ID NO: 445 - DNA, 30 bp, Artificial Sequence
  PCR primer
cgtcaagatcttcattacttccgtcttgac

SEQ ID NO: 446 - protein, 579 aa, Homo sapiens; identical to SEQ ID NO: 348

SEQ ID NO: 447 - DNA, 1743 bp, Homo sapiens
atgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaacggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaatga

SEQ ID NO: 448 - DNA, 35 bp, Artificial Sequence
  PCR primer
cgtactagcatatgaacaaactgtatatcggaaac

SEQ ID NO: 449 - protein, 579 aa, Homo sapiens; identical to SEQ ID NO: 348

SEQ ID NO: 450 - DNA, 1743 bp, Homo sapiens; identical to SEQ ID NO: 447

SEQ ID NO: 451 - protein, 25 aa, Homo sapiens
LGKEVRDAKITPEAFEKLGFPAAKE

SEQ ID NO: 452 - protein, 25 aa, Homo sapiens
KASDGDYYTLAVPMGDVPMDGISVA

SEQ ID NO: 453 - protein, 16 aa, Homo sapiens
PDRDVNLTHQLNPKVK

SEQ ID NO: 454 - protein, 20 aa, Homo sapiens
KIAPAEAPDAKVRMVIITGP

SEQ ID NO: 455 - protein, 20 aa, Homo sapiens
PDETAAQQNPLQQPRGRRGL

SEQ ID NO: 456 - protein, 20 aa, Homo sapiens
RTITVKGNVETCAKAEEEIM

SEQ ID NO: 457 - protein, 20 aa, Homo sapiens
AFVDCPDESWALKAIEALSG

SEQ ID NO: 458 - protein, 20 aa, Homo sapiens
IRKLQIRNIPPHLQWEVLDS

SEQ ID NO: 459 - protein, 20 aa, Homo sapiens
AQQNPLQQPRGRRGLGQRGS

SEQ ID NO: 460 - protein, 20 aa, Homo sapiens
DVHRKENAGAAEKSITILST

SEQ ID NO: 461 - protein, 20 aa, Homo sapiens
LYNPERTITVKGNVETCAKA

SEQ ID NO: 462 - protein, 20 aa, Homo sapiens
EEEIMKKIRESYENDIASMN

SEQ ID NO: 463 - protein, 20 aa, Homo sapiens
LNALGLFPPTSGMPPPTSGP

SEQ ID NO: 464 - protein, 20 aa, Homo sapiens
KIAPAEAPDAKVRMVIITGP

SEQ ID NO: 465 - protein, 18 aa, Homo sapiens
TGYAFVDCPDESWALKIE

SEQ ID NO: 466 - protein, 11 aa, Homo sapiens
FVDCPDESWAL

SEQ ID NO: 467 - DNA, 33 bp, Homo sapiens
ttcgtggactgcccggacgagagctgggccctc

SEQ ID NO: 468 - protein, 24 aa, Homo sapiens
IPDEMAAQQNPLQQPRGRRGLGQR

SEQ ID NO: 469 - protein, 24 aa, Homo sapiens
IPDETAAQQNPSPQLRGRRGPGQR

SEQ ID NO: 470 - protein, 20 aa, Homo sapiens
SGPFLVKTGYAFVDCPDESW

SEQ ID NO: 471 - protein, 70 aa, Homo sapiens
DQARQALDKLNGFQLENFTLKVAYIPDETAAQQNPLQQPRGRRGLGQRGSSRQGSPGSVSKQKPCDLPLR

SEQ ID NO: 472 - protein, 70 aa, Homo sapiens
KQKPCDLPLRLLVPTQFVGAIIGKEGATIRNITKQTQSKIDVHRKENAGAAEKSITILSTPEGTSAACKS

SEQ ID NO: 473 - protein, 70 aa, Homo sapiens
PEGTSAACKSILEIMHKEAQDIKFTEEIPLKILAHNNFVGRLIGKEGRNLKKIEQDTDTKITISPLQELT

SEQ ID NO: 474 - protein, 70 aa, Homo sapiens
ITISPLQELTLYNPERTITVKGNVETCAKAEEEIMKKIRESYENDIASMNLQAHLIPGLNLNALGLFPPT

SEQ ID NO: 475 - protein, 70 aa, Homo sapiens
LNALGLFPPTSGMPPPTSGPPSAMTPPYPQFEQSETETVHLFIPALSVGAIIGKQGQHIKQLSRFAGASI

SEQ ID NO: 476 - protein, 81 aa, Homo sapiens
KQLSRFAGASIKIAPAEAPDAKVRMVIITGPPEAQFKAQGRIYGKIKEENFVSPKEEVKLEAHIRVPSFAAGRVIGKGGKT

SEQ ID NO: 477 - protein, 80 aa, Homo sapiens
GRVIGKGGKTVNELQNLSSAEVVVPRDQTPDENDQVVVKITGHFYACQVAQRKIQEILTQVKQHQQQKALQSGPPQSRRK

SEQ ID NO: 478 - DNA, 1740 bp, Homo sapiens; identical to SEQ ID NO: 347

SEQ ID NO: 479 - DNA, 34555 bp, Homo sapiens
  misc_feature 34543,34544,34545,34546,34547: n = A,T,C or G
ttaattaacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactgtaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatctggtaccgtcgacgcggccgctcgagcctaagcttctagagccgccaccatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaacggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaatctagagccgccaccatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaacggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaatctagataagatatccgatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcggatctgggcgtggttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagagggagtttgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgtccttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccttggattacatcaagatcctctagttataactagagtacccggggatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccttgacaaaagaacccacactgattatgacacgcatactcggagctatgctaaccagcgtagccccgatgtaagctttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttcacagcggcagcctaacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtaacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatnnnnnttaattaa

SEQ ID NO: 480 - protein, 579 aa, Homo sapiens; identical to SEQ ID NO: 348

SEQ ID NO: 481 - protein, 19 aa, Homo sapiens
LSENAAPSDLESIFKDAKI

SEQ ID NO: 482 - protein, 43 aa, Homo sapiens
FLVKTGYAFVDCPDESWALKAIEALSGKIELHGKPIEVEHSVP

SEQ ID NO: 483 - DNA, 1740 bp, primate
atgaacaaactgtatatcggaaacctcagcgacaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcacttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatctgtgtccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcaggggctgctgagaagtcaattactatcctctctacacctgaaggcacctctgcggcttgtaagtctattctggagatcatgcataaggaagctcaagatataaaattcacagaagagatccccttgaagattttagctcataataactttgttggccgtcttattggtaaagaaggaagaaatcttaaaaaaattgagcaggacacagacactaaaatcacgatatctccattgcaggaattgacgctgtataatccagaacgcaccattacagttaaaggcaatgttgagacgtgtgccaaagctgaggaagagatcatgaagaaaattagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctctttatcccggctctatcagtcggtgccatcattggcaagcagggccagcacatcaagcagctttctcgctttgctggagcttcaattaagattgctccagcagaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatgctttgctggtggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaa

SEQ ID NO: 484 - protein, 579 aa, primate
MNKLYIGNLSDNAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPCFAGGRVIGKGGKTVNELQNLSSAEVVVPRDQTPDENDQVVVKITGHFYACQVAQRKIQEILTQVKQHQQQKALQSGPPQSRRK

SEQ ID NO: 485 - DNA, 1799 bp, Homo sapiens
gggggaattcgccgccaccatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaacggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagcatcatcaccatcatcatcaccatcaccattaagaattccccc

SEQ ID NO: 486 - protein, 589 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDETAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRKHHHHHHHHHH

SEQ ID NO: 487 - DNA, 49 bp, Artificial Sequence
  PCR primer
gggggaattcgccgccaccatgaacaaactgtatatcggaaacctcagc

SEQ ID NO: 488 - DNA, 67 bp, Artificial Sequence
  PCR primer
gggggaattcttaatggtgatggtgatgatgatggtgatgatgcttccgtcttgactgaggtggtcc

SEQ ID NO: 489 - DNA, 30 bp, Homo sapiens
tcagagaaccagggagccttcaagggcatg

SEQ ID NO: 490 - protein, 10 aa, Homo sapiens
SENQGAFKGM

SEQ ID NO: 491 - protein, 9 aa, Homo sapiens
AAPSDLESI

SEQ ID NO: 492 - protein, 20 aa, Homo sapiens
STGDADGPGGPGIPDGPGGN

SEQ ID NO: 493 - protein, 20 aa, Homo sapiens
PGIPDGPGGNAGGPGEAGAT

SEQ ID NO: 494 - protein, 20 aa, Homo sapiens
YLAMPFATPMEAELARRSLA

SEQ ID NO: 495 - protein, 20 aa, Homo sapiens
WITQCFLPVFLAQPPSGQRR

SEQ ID NO: 496 - protein, 20 aa, Homo sapiens
GGRGPRGAGAARASGPGGGA

SEQ ID NO: 497 - protein, 20 aa, Homo sapiens
KIAPAEAPDAKVRMVIITGP

SEQ ID NO: 498 - protein, 20 aa, Homo sapiens
KIAPPETPDSKVRMVIITGP

SEQ ID NO: 499 - protein, 20 aa, Homo sapiens
KIAPAEGPDVSERMVIITGP

SEQ ID NO: 500 - protein, 577 aa, Homo sapiens
MNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQAIMKLNGHQLENHALKVSYIPDEQIAQGPENGRRGGFGSRGQPRQGSPVAAGAPAKQQQVDIPLRLLVPTQYVGAIIGKEGATIRNITKQTQSKIDVHRKENAGAAEKAISVHSTPEGCSSACKMILEIMHKEAKDTKTADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 501 - protein, 587 aa, Homo sapiens
MNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQK

SEQ ID NO: 502 - protein, 20 aa, Homo sapiens
LYNPERTITVKGAIENCCRA

SEQ ID NO: 503 - protein, 20 aa, Homo sapiens
LYNPERTITVKGTCEACASA

SEQ ID NO: 504 - protein, 19 aa, Homo sapiens
MNKLYIGNLSENAAPSDLE

SEQ ID NO: 505 - protein, 20 aa, Homo sapiens
SENAAPSDLESIFKDAKIPV

SEQ ID NO: 506 - protein, 20 aa, Homo sapiens
SIFKDAKIPVSGPFLVKTGY

SEQ ID NO: 507 - protein, 20 aa, Homo sapiens
SGPFLVKTGYAFVDCPDESW

SEQ ID NO: 508 - protein, 20 aa, Homo sapiens
AFVDCPDESWALKAIEALSG

SEQ ID NO: 509 - protein, 20 aa, Homo sapiens
ALKAIEALSGKIELHGKPIE

SEQ ID NO: 510 - protein, 20 aa, Homo sapiens
KIELHGKPIEVEHSVPKRQR

SEQ ID NO: 511 - protein, 20 aa, Homo sapiens
VEHSVPKRQRIRKLQIRNIP

SEQ ID NO: 512 - protein, 20 aa, Homo sapiens
IRKLQIRNIPPHLQWEVLDS

SEQ ID NO: 513 - protein, 20 aa, Homo sapiens
PHLQWEVLDSLLVQYGVVES

SEQ ID NO: 514 - protein, 20 aa, Homo sapiens
LLVQYGVVESCEQVNTDSET

SEQ ID NO: 515 - protein, 19 aa, Homo sapiens
EQVNTDSETAVVNVTYSSK

SEQ ID NO: 516 - protein, 20 aa, Homo sapiens
AVVNVTYSSKDQARQALDKL

SEQ ID NO: 517 - protein, 20 aa, Homo sapiens
DQARQALDKLNGFQLENFTL

SEQ ID NO: 518 - protein, 20 aa, Homo sapiens
NGFQLENFTLKVAYIPDETA

SEQ ID NO: 519 - protein, 20 aa, Homo sapiens
KVAYIPDETAAQQNPLQQPR

SEQ ID NO: 520 - protein, 20 aa, Homo sapiens
AQQNPLQQPRGRRGLGQRGS

SEQ ID NO: 521 - protein, 20 aa, Homo sapiens
GRRGLGQRGSSRQGSPGSVS

SEQ ID NO: 522 - protein, 20 aa, Homo sapiens
SRQGSPGSVSKQKPCDLPLR

SEQ ID NO: 523 - protein, 20 aa, Homo sapiens
KQKPCDLPLRLLVPTQFVGA

SEQ ID NO: 524 - protein, 20 aa, Homo sapiens
LLVPTQFVGAIIGKEGATIR

SEQ ID NO: 525 - protein, 20 aa, Homo sapiens
IIGKEGATIRNITKQTQSKI

SEQ ID NO: 526 - protein, 20 aa, Homo sapiens
NITKQTQSKIDVHRKENAGA

SEQ ID NO: 527 - protein, 20 aa, Homo sapiens
DVHRKENAGAAEKSITILST

SEQ ID NO: 528 - protein, 20 aa, Homo sapiens
AEKSITILSTPEGTSAACKS

SEQ ID NO: 529 - protein, 20 aa, Homo sapiens
PEGTSAACKSILEIMHKEAQ

SEQ ID NO: 530 - protein, 20 aa, Homo sapiens
ILEIMHKEAQDIKFTEEIPL

SEQ ID NO: 531 - protein, 20 aa, Homo sapiens
DIKFTEEIPLKILAHNNFVG

SEQ ID NO: 532 - protein, 20 aa, Homo sapiens
KILAHNNFVGRLIGKEGRNL

SEQ ID NO: 533 - protein, 20 aa, Homo sapiens
RLIGKEGRNLKKIEQDTDTK

SEQ ID NO: 534 - protein, 20 aa, Homo sapiens
KKIEQDTDTKITISPLQELT

SEQ ID NO: 535 - protein, 20 aa, Homo sapiens
ITISPLQELTLYNPERTITV

SEQ ID NO: 536 - protein, 20 aa, Homo sapiens
LYNPERTITVKGNVETCAKA

SEQ ID NO: 537 - protein, 20 aa, Homo sapiens
KGNVETCAKAEEEIMKKIRE

SEQ ID NO: 538 - protein, 20 aa, Homo sapiens
EEEIMKKIRESYENDIASMN

SEQ ID NO: 539 - protein, 20 aa, Homo sapiens
SYENDIASMNLQAHLIPGLN

SEQ ID NO: 540 - protein, 20 aa, Homo sapiens
LQAHLIPGLNLNALGLFPPT

SEQ ID NO: 541 - protein, 20 aa, Homo sapiens
LNALGLFPPTSGMPPPTSGP

SEQ ID NO: 542 - protein, 20 aa, Homo sapiens
SGMPPPTSGPPSAMTPPYPQ

SEQ ID NO: 543 - protein, 23 aa, Homo sapiens
PSAMTPPYPQFEQSETETVHLFI

SEQ ID NO: 544 - protein, 20 aa, Homo sapiens
FEQSETETVHLFIPALSVGA

SEQ ID NO: 545 - protein, 20 aa, Homo sapiens
LFIPALSVGAIIGKQGQHIK

SEQ ID NO: 546 - protein, 20 aa, Homo sapiens
IIGKQGQHIKQLSRFAGASI

SEQ ID NO: 547 - protein, 21 aa, Homo sapiens
KQLSRFAGASIKIAPAEAPDA

SEQ ID NO: 548 - protein, 20 aa, Homo sapiens
KIAPAEAPDAKVRMVIITGP

SEQ ID NO: 549 - protein, 20 aa, Homo sapiens
KVRMVIITGPPEAQFKAQGR

SEQ ID NO: 550 - protein, 20 aa, Homo sapiens
PEAQFKAQGRIYGKIKEENF

SEQ ID NO: 551 - protein, 20 aa, Homo sapiens
IYGKIKEENFVSPKEEVKLE

SEQ ID NO: 552 - protein, 20 aa, Homo sapiens
VSPKEEVKLEAHIRVPSFAA

SEQ ID NO: 553 - protein, 20 aa, Homo sapiens
AHIRVPSFAAGRVIGKGGKT

SEQ ID NO: 554 - protein, 20 aa, Homo sapiens
GRVIGKGGKTVNELQNLSSA

SEQ ID NO: 555 - protein, 20 aa, Homo sapiens
VNELQNLSSAEVVVPRDQTP

SEQ ID NO: 556 - protein, 20 aa, Homo sapiens
EVVVPRDQTPDENDQVVVKI

SEQ ID NO: 557 - protein, 20 aa, Homo sapiens
DENDQVVVKITGHFYACQVA

SEQ ID NO: 558 - protein, 20 aa, Homo sapiens
TGHFYACQVAQRKIQEILTQ

SEQ ID NO: 559 - protein, 21 aa, Homo sapiens
AQRKIQEILTQVKQHQQQKAL

SEQ ID NO: 560 - protein, 20 aa, Homo sapiens
VKQHQQQKALQSGPPQSRRK

What is claimed:

1. An isolated polynucleotide comprising a sequence selected from the group consisting of:
    (a) the sequence provided in SEQ ID No. 160; and
    (b) degenerate variants of the sequence provided in SEQ ID No. 160, wherein the degenerate variants encode the polypeptide sequence provided in SEQ ID No. 161.

2. An expression vector comprising the polynucleotide of claim 1 operably linked to an expression control sequence.

3. An isolated host cell transformed or transfected with the expression vector according to claim 2.

4. A composition comprising a first component selected from the group consisting of physiologically acceptable carriers and immunostimulants, and a second component comprising the isolated polynucleotide according to claim 1.

5. A method for stimulating an immune response in a patient, comprising administering to the patient a suitable dose of the composition of claim 4, thereby stimulating an immune response in the patient.

6. An isolated polynucleotide comprising the complement of the sequence of SEQ ID No. 160.

* * * * *